(12) United States Patent
Brown et al.

(10) Patent No.: US 10,689,647 B2
(45) Date of Patent: Jun. 23, 2020

(54) METHODS AND COMPOSITIONS FOR THE SPECIFIC INHIBITION OF ANTITHROMBIN 3 (AT3) BY DOUBLE-STRANDED RNA

(71) Applicant: Dicerna Pharmaceuticals, Inc., Cambridge, MA (US)

(72) Inventors: Bob D. Brown, Littleton, MA (US); Henryk T. Dudek, Wellesley, MA (US)

(73) Assignee: Dicerna Pharmaceuticals, Inc., Lexington, MA (US)

( * ) Notice: Subject to any disclaimer, the term of this patent is extended or adjusted under 35 U.S.C. 154(b) by 0 days.

(21) Appl. No.: 15/572,663

(22) PCT Filed: May 9, 2016

(86) PCT No.: PCT/US2016/031471
§ 371 (c)(1),
(2) Date: Nov. 8, 2017

(87) PCT Pub. No.: WO2016/183009
PCT Pub. Date: Nov. 17, 2016

(65) Prior Publication Data
US 2018/0282723 A1 Oct. 4, 2018

Related U.S. Application Data

(60) Provisional application No. 62/159,037, filed on May 8, 2015.

(51) Int. Cl.
| | | |
|---|---|---|
| *C12N 15/113* | (2010.01) | |
| *C07H 21/02* | (2006.01) | |
| *A61P 7/00* | (2006.01) | |
| *C07H 21/04* | (2006.01) | |

(52) U.S. Cl.
CPC ............ *C12N 15/113* (2013.01); *A61P 7/00* (2018.01); *C07H 21/02* (2013.01); *C07H 21/04* (2013.01); *C12N 2310/11* (2013.01); *C12N 2310/14* (2013.01); *C12N 2310/321* (2013.01); *C12N 2310/344* (2013.01); *C12N 2310/345* (2013.01); *C12N 2310/346* (2013.01); *C12N 2310/3521* (2013.01); *C12N 2310/533* (2013.01)

(58) Field of Classification Search
CPC ........ C12N 2310/315; C12N 2310/321; C12N 2310/322; C12N 15/113; C12N 2320/30; A61K 31/713
USPC .... 435/6.1, 91.1, 91.31, 455, 458; 536/23.1, 536/24.5
See application file for complete search history.

(56) References Cited

U.S. PATENT DOCUMENTS

| | | | |
|---|---|---|---|
| 5,684,143 A | 11/1997 | Gryaznov et al. | |
| 5,858,988 A | 1/1999 | Wang | |
| 6,291,438 B1 | 9/2001 | Wang | |
| 8,084,599 B2 | 12/2011 | Rossi et al. | |
| 8,349,809 B2 | 1/2013 | Brown | |
| 8,513,207 B2 | 8/2013 | Brown | |
| 9,127,274 B2* | 9/2015 | Akinc | A61K 31/713 |
| 2004/0203145 A1 | 10/2004 | Zamore et al. | |
| 2005/0225487 A1 | 10/2005 | Fujii et al. | |
| 2005/0244858 A1 | 11/2005 | Rossi et al. | |
| 2005/0277610 A1 | 12/2005 | Rossi et al. | |
| 2007/0223427 A1 | 9/2007 | Nakatsugawa | |
| 2007/0265220 A1 | 11/2007 | Rossi et al. | |
| 2010/0173974 A1 | 7/2010 | Brown | |
| 2011/0288147 A1 | 11/2011 | Brown | |

FOREIGN PATENT DOCUMENTS

| | | |
|---|---|---|
| WO | WO 2005/116204 A1 | 12/2005 |
| WO | WO 2006/006948 A2 | 1/2006 |
| WO | WO 2010/080129 A1 | 1/2010 |
| WO | WO 2010/080129 A2 | 7/2010 |

OTHER PUBLICATIONS

Genbank Accession No. NM_000488.3. Dec. 23, 2018. Corral et al.
Genbank Accession No. NP_000479.1. Dec. 23, 2018. Corral et al.
Genbank Accession No. NP_543120.1. Nov. 12, 2018. Heit et al.
Genbank Accession No. NM_080844.4. Nov. 12, 2018. Heit et al.
Amarzguioui et al., Tolerance for mutations and chemical modifications in a siRNA. Nucleic Acids Res. Jan. 15, 2003;31(2):589-95.
Braasch et al., RNA interference in mammalian cells by chemically-modified RNA. Biochemistry. Jul. 8, 2003;42(26):7967-75.
Chiu et al., RNAi in human cells: basic structural and functional features of small interfering RNA. Mol Cell. Sep. 2002;10(3):549-61.
Choung et al., Chemical modification of siRNAs to improve serum stability without loss of efficacy. Biochem Biophys Res Commun. Apr. 14, 2006;342(3):919-27.
Harborth et al., Sequence, chemical, and structural variation of small interfering RNAs and short hairpin RNAs and the effect on mammalian gene silencing. Antisense Nucleic Acid Drug Dev. Apr. 2003;13(2):83-105.
Khvorova et al., Functional siRNAs and miRNAs exhibit strand bias. Cell. Oct. 17, 2003;115(2):209-16. Erratum in: Cell. Nov. 14, 2003;115(4):505.
Reynolds et al., Rational siRNA design for RNA interference. Nat Biotechnol. Mar. 2004;22(3):326-30. Epub Feb. 1, 2004.
Schwarz et al., Asymmetry in the assembly of the RNAi enzyme complex. Cell. Oct. 17, 2003;115(2):199-208.
Ui-Tei et al., Guidelines for the selection of highly effective siRNA sequences for mammalian and chick RNA interference. Nucleic Acids Res. Feb. 9, 2004;32(3):936-48. Print 2004.
Antao et al., A thermodynamic study of unusually stable RNA and DNA hairpins. Nucleic Acids Res. Nov. 11, 1991;19(21):5901-5.

(Continued)

*Primary Examiner* — Jane J Zara
(74) *Attorney, Agent, or Firm* — Andrea L. C. Reid; Dechert LLP

(57) ABSTRACT

This invention relates to compounds, compositions, and methods useful for reducing AT3 target RNA and protein levels via use of dsRNAs, e.g., Dicer substrate siRNA (DsiRNA) agents.

32 Claims, 29 Drawing Sheets

Specification includes a Sequence Listing.

(56) References Cited

OTHER PUBLICATIONS

Hong et al., High doses of siRNAs induce eri-1 and adar-1 gene expression and reduce the efficiency of RNA interference in the mouse. Biochem J. Sep. 15, 2005;390(Pt 3):675-9.
Woese et al., Architecture of ribosomal RNA: constraints on the sequence of "tetra-loops". Proc Natl Acad Sci U S A. Nov. 1990;87(21):8467-71.
PCT/US2016/031471, Oct. 26, 2016, International Search Report and Written Opinion.

* cited by examiner

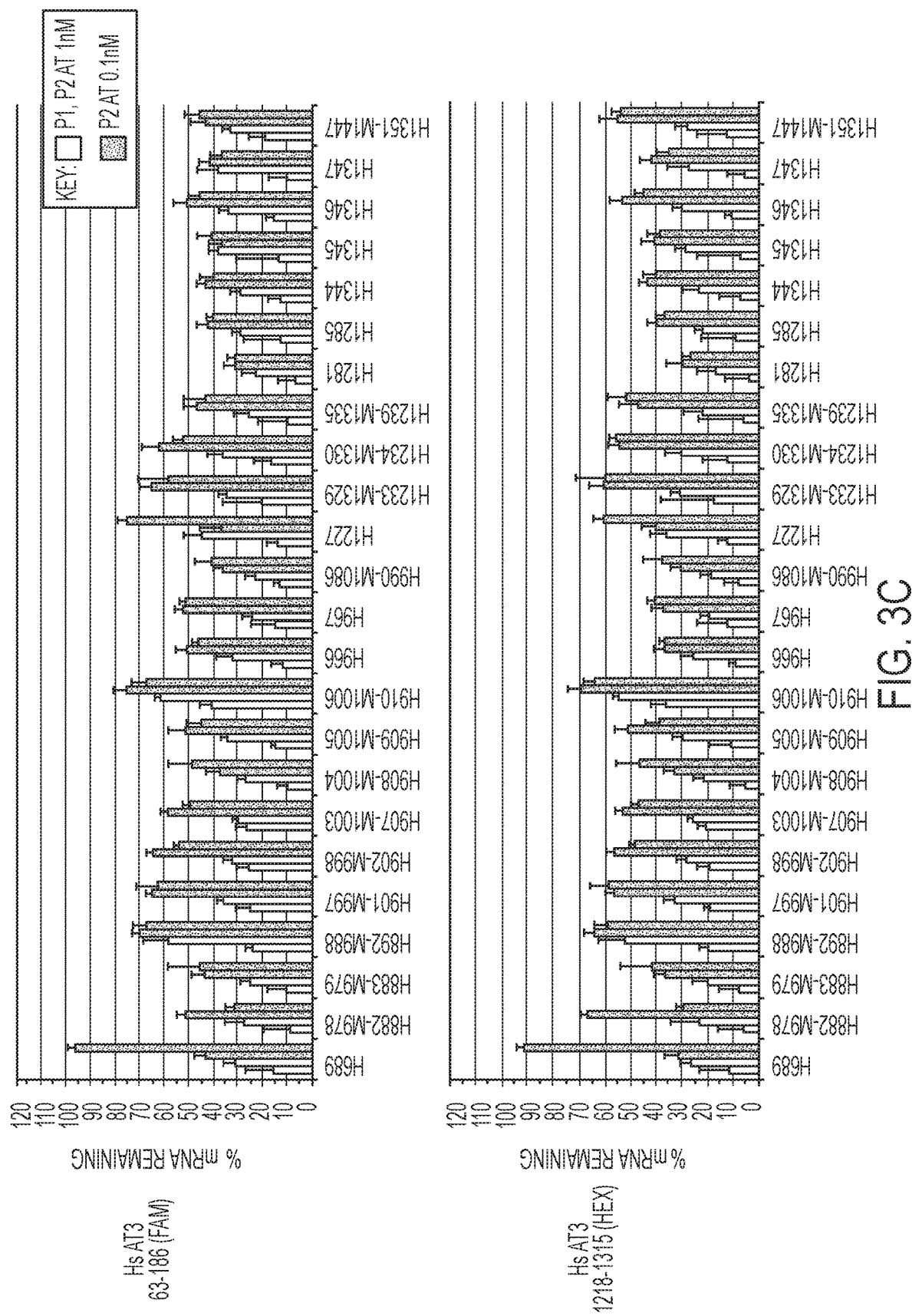

AT3-179-TL
(SEQ ID NO: 3546)   5'-AAAAAGGAAGGUUUAUCUUUGCAGCC<sup>G</sup> A
(SEQ ID NO: 3636)   3'-CCUUUUUCCUUCCAAAUAGAAACGUCGG A
                                                     A
                                                  5'|
                                                    |
                                                  3'

AT3-179-TL 22nt mRNA Target:
5'-GGAAAAAGGAAGGUUUAUCUUU-3' (SEQ ID NO: 3726)

FIG. 5

METHODS AND COMPOSITIONS FOR THE SPECIFIC INHIBITION OF ANTITHROMBIN 3 (AT3) BY DOUBLE-STRANDED RNA

RELATED APPLICATIONS

The present application is a national stage filing under U.S.C. § 371 of PCT International Application PCT/US2016/031471, filed May 9, 2016 entitled "METHODS AND COMPOSITIONS FOR THE SPECIFIC INHIBITION OF ANTITHROMBIN 3 (AT3) BY DOUBLE-STRANDED RNA," which claims priority to, and the benefit under 35 U.S.C. § 119(e) of U.S. provisional application No. 62/159,037, entitled "Methods and Compositions for the Specific Inhibition of Antithrombin 3 (AT3) by Double-Stranded RNA," filed May 8, 2015. The the contents of which are incorporated by reference herein in their entireties.

FIELD OF THE INVENTION

The present invention relates to compounds, compositions, and methods for the study, diagnosis, and treatment of traits, diseases and conditions that respond to the modulation of Antithrombin 3 (AT3; SERPINC1) gene expression and/or activity.

SEQUENCE SUBMISSION

The present application is being filed along with a Sequence Listing in electronic format. The Sequence Listing is entitled "517001WOSequenceListing", was created on May 9, 2016 and is 752 KB in size. The information in the electronic format of the Sequence Listing is part of the present application and is incorporated herein by reference in its entirety.

BACKGROUND OF THE INVENTION

Hemophilia is a rare, genetically acquired disorder in which blood does not clot properly due to a lack of clotting proteins (coagulation factors) and/or non-protein blood coagulation compounds (e.g., calcium, phosphate and platelet glycerides). Individuals with the disease do not bleed more intensely, just for longer periods of time. Three types of hemophilia are classified according to the deficient factor. Hemophilia A is the most common and is caused by insufficient levels of factor VIII, whereas hemophilia B and C are less common and are caused by insufficient factor IX and XI levels, respectively. The effects of the disease are often profound: uncontrolled internal bleeding can damage organs and tissues, threatening survival. Currently, no cure for hemophilia exists; however, regular intravenous infusions of the deficient clotting factor can help control the disease. The current standard of care is both inconvenient to the patient and very costly. Therefore, a need exists for additional therapies that target the coagulation cascade, either as a substitute for or in conjunction with clotting factor infusion.

Antithrombin III (AT3, also known as SERPINC1) is a key natural anticoagulant and a genetically defined target. AT3 is expressed in the liver and circulates in the plasma. It inactivates a critical protein, thrombin, which is involved in clotting. While primarily an inhibitor of thrombin, AT3 also inhibits certain activated clotting factors (Xa, IXa, XaI, XIIa, IIa, and VIIa). Thus, an effective inhibitor of AT3 would prevent the ability of AT3 to inactivate thrombin, resulting in increased active thrombin and clot formation, thereby providing an additional hemophilia therapeutic.

Double-stranded RNA (dsRNA) agents that are believed to be processed by the Dicer enzyme of the RNA interference (RNAi) pathway—leading such agents to be termed "Dicer substrate siRNA" ("DsiRNA") agents—have been described as effective inhibitors of target gene expression in mammalian cells (Rossi et al., U.S. Pat. No. 8,084,599 and U.S. Patent Application No. 2005/0277610). Additional modified structures of DsiRNA agents were previously described (Rossi et al., U.S. Patent Application No. 2007/0265220). Effective extended forms of Dicer substrates have also been more recently described (Brown, U.S. Pat. Nos. 8,349,809 and 8,513,207).

BRIEF SUMMARY OF THE INVENTION

The present invention is based, at least in part, upon the identification of AT3 as an attractive target for dsRNA-based knockdown therapies. In particular, provided herein are nucleic acid agents that target and reduce expression of AT3. Such compositions contain nucleic acids such as double stranded RNA ("dsRNA"), and methods for preparing them. The nucleic acids of the invention are capable of reducing the expression of a target AT3 gene in a cell, either in vitro or in a mammalian subject.

In one aspect, the invention provides a nucleic acid possessing an oligonucleotide strand of 15-80 nucleotides in length, where the oligonucleotide strand is sufficiently complementary to a target AT3 mRNA sequence of SEQ ID NOs: 1921-2304 along at least 15 nucleotides of the oligonucleotide strand length to reduce AT3 target mRNA expression when the nucleic acid is introduced into a mammalian cell.

Another aspect of the invention provides a nucleic acid possessing an oligonucleotide strand of 19-80 nucleotides in length, where the oligonucleotide strand is sufficiently complementary to a target AT3 mRNA sequence of SEQ ID NOs: 1921-2304 along at least 19 nucleotides of the oligonucleotide strand length to reduce AT3 target mRNA expression when the nucleic acid is introduced into a mammalian cell.

In one embodiment, the oligonucleotide strand is 19-35 nucleotides in length.

An additional aspect of the invention provides a double stranded nucleic acid (dsNA) possessing first and second nucleic acid strands including RNA, where the first strand is 15-66 nucleotides in length and the second strand of the dsNA is 19-66 nucleotides in length, where the second oligonucleotide strand is sufficiently complementary to a target AT3 mRNA sequence of SEQ ID NOs: 1921-2304 along at least 15 nucleotides of the second oligonucleotide strand length to reduce AT3 target mRNA expression when the double stranded nucleic acid is introduced into a mammalian cell.

Another aspect of the invention provides a double stranded nucleic acid (dsNA) possessing first and second nucleic acid strands, where the first strand is 15-66 nucleotides in length and the second strand of the dsNA is 19-66 nucleotides in length, where the second oligonucleotide strand is sufficiently complementary to a target AT3 mRNA sequence of SEQ ID NOs: 1921-2304 along at least 19 nucleotides of the second oligonucleotide strand length to reduce AT3 target mRNA expression when the double stranded nucleic acid is introduced into a mammalian cell.

A further aspect of the invention provides a double stranded nucleic acid (dsNA) possessing first and second nucleic acid strands, where the first strand is 15-66 nucleotides in length and the second strand of the dsNA is 19-66 nucleotides in length, where the second oligonucleotide strand is sufficiently complementary to a target AT3 mRNA sequence of SEQ ID NOs: 1921-2304 along at least 19 nucleotides of the second oligonucleotide strand length to reduce AT3 target mRNA expression, and where, starting from the 5' end of the AT3 mRNA sequence of SEQ ID NOs: 1921-2304 (position 1), mammalian Ago2 cleaves the mRNA at a site between positions 9 and 10 of the sequence, when the double stranded nucleic acid is introduced into a mammalian cell.

Another aspect of the invention provides a dsNA molecule, consisting of: (a) a sense region and an antisense region, where the sense region and the antisense region together form a duplex region consisting of 25-66 base pairs and the antisense region includes a sequence that is the complement of a sequence of SEQ ID NOs: 1921-2304; and (b) from zero to two 3' overhang regions, where each overhang region is six or fewer nucleotides in length, and where, starting from the 5' end of the AT3 mRNA sequence of SEQ ID NOs: 1921-2304 (position 1), mammalian Ago2 cleaves the mRNA at a site between positions 9 and 10 of the sequence, when the double stranded nucleic acid is introduced into a mammalian cell.

An additional aspect of the invention provides a double stranded nucleic acid (dsNA) possessing first and second nucleic acid strands and a duplex region of at least 25 base pairs, where the first strand is 25-65 nucleotides in length and the second strand of the dsNA is 26-66 nucleotides in length and includes 1-5 single-stranded nucleotides at its 3' terminus, where the second oligonucleotide strand is sufficiently complementary to a target AT3 mRNA sequence of SEQ ID NOs: 1921-2304 along at least 19 nucleotides of the second oligonucleotide strand length to reduce AT3 target gene expression when the double stranded nucleic acid is introduced into a mammalian cell.

Another aspect of the invention provides a double stranded nucleic acid (dsNA) possessing first and second nucleic acid strands and a duplex region of at least 25 base pairs, where the first strand is 25-65 nucleotides in length and the second strand of the dsNA is 26-66 nucleotides in length and includes 1-5 single-stranded nucleotides at its 3' terminus, where the 3' terminus of the first oligonucleotide strand and the 5' terminus of the second oligonucleotide strand form a blunt end, and the second oligonucleotide strand is sufficiently complementary to a target AT3 sequence of SEQ ID NOs: 1921-2304 along at least 19 nucleotides of the second oligonucleotide strand length to reduce AT3 mRNA expression when the double stranded nucleic acid is introduced into a mammalian cell.

In one embodiment, the first strand is 15-35 nucleotides in length.

In another embodiment, the second strand is 19-35 nucleotides in length.

In an additional embodiment, the dsNA possesses a duplex region of at least 25 base pairs; 19-21 base pairs or 21-25 base pairs.

Optionally, the second oligonucleotide strand includes 1-5 single-stranded nucleotides at its 3' terminus.

In one embodiment, the second oligonucleotide strand includes 5-35 single-stranded nucleotides at its 3' terminus.

In another embodiment, the single-stranded nucleotides include modified nucleotides. Optionally, the single-stranded nucleotides include 2'-O-methyl, 2'-methoxyethoxy, 2'-fluoro, 2'-allyl, 2'-O-[2-(methylamino)-2-oxoethyl], 4'-thio, 4'-CH2-O-2'-bridge, 4'-(CH2)2-O-2'-bridge, 2'-LNA, 2'-amino and/or 2'-O—(N-methlycarbamate) modified nucleotides.

In certain embodiments, the single-stranded nucleotides include ribonucleotides. Optionally, the single-stranded nucleotides include deoxyribonucleotides.

In certain embodiments, the 3' end of the first strand and the 5' end of the second strand of a dsNA or hybridization complex of the invention are joined by a polynucleotide sequence that includes ribonucleotides, deoxyribonucleotides or both, optionally the polynucleotide sequence includes a tetraloop sequence.

In one embodiment, the first strand is 25-35 nucleotides in length. Optionally, the second strand is 25-35 nucleotides in length.

In one embodiment, the second oligonucleotide strand is complementary to target AT3 cDNA sequence GenBank Accession No. NM_000488.3 along at most 27 nucleotides of the second oligonucleotide strand length.

In another embodiment, starting from the first nucleotide (position 1) at the 3' terminus of the first oligonucleotide strand, position 1, 2 and/or 3 is substituted with a modified nucleotide.

Optionally, the first strand and the 5' terminus of the second strand form a blunt end.

In one embodiment, the first strand is 25 nucleotides in length and the second strand is 27 nucleotides in length.

In another embodiment, starting from the 5' end of an AT3 mRNA sequence of SEQ ID NOs: 1921-2304 (position 1), mammalian Ago2 cleaves the mRNA at a site between positions 9 and 10 of the sequence, thereby reducing AT3 target mRNA expression when the double stranded nucleic acid is introduced into a mammalian cell.

In one embodiment, the second strand includes a sequence of SEQ ID NOs: 385-768. In an additional embodiment, the first strand includes a sequence of SEQ ID NOs: 1-384.

In another embodiment, the dsNA of the invention possesses a pair of first strand/second strand sequences of Table 2.

Optionally, the modified nucleotide residue of the 3' terminus of the first strand is a deoxyribonucleotide, an acyclonucleotide or a fluorescent molecule.

In one embodiment, position 1 of the 3' terminus of the first oligonucleotide strand is a deoxyribonucleotide.

In another embodiment, the nucleotides of the 1-5 or 5-35 single-stranded nucleotides of the 3' terminus of the second strand comprise a modified nucleotide.

In one embodiment, the modified nucleotide of the 1-5 or 5-35 single-stranded nucleotides of the 3' terminus of the second strand is a 2'-O-methyl ribonucleotide.

In an additional embodiment, all nucleotides of the 1-5 or 5-35 single-stranded nucleotides of the 3' terminus of the second strand are modified nucleotides.

In another embodiment, the dsNA includes a modified nucleotide. Optionally, the modified nucleotide residue is 2'-O-methyl, 2'-methoxyethoxy, 2'-fluoro, 2'-allyl, 2'-O-[2-(methylamino)-2-oxoethyl], 4'-thio, 4'-CH2-O-2'-bridge, 4'-(CH2)2-O-2'-bridge, 2'-LNA, 2'-amino or 2'-O—(N-methlycarbamate).

In one embodiment, the 1-5 or 5-35 single-stranded nucleotides of the 3' terminus of the second strand are 1-3 nucleotides in length, optionally 1-2 nucleotides in length.

In another embodiment, the 1-5 or 5-35 single-stranded nucleotides of the 3' terminus of the second strand is two nucleotides in length and includes a 2'-O-methyl modified ribonucleotide.

In one embodiment, the second oligonucleotide strand includes a modification pattern of AS-M1 to AS-M96, AS-M101, AS-M104 to AS-M117, AS-M120 to AS-M164, AS-M210 to AS-M255, AS-M1* to AS-M96*, AS-M101*, AS-M104* to AS-M117*, AS-M120* to AS-M164*, or AS-M210* to AS-M255*.

In another embodiment, the first oligonucleotide strand includes a modification pattern of SM1 to SM130, SM133 to SM138, SM140 to SM160, SM250, SM253, SM255 to SM271, SM275 to SM289 and SM300 to SM310.

In an additional embodiment, each of the first and the second strands has a length which is at least 26 and at most 30 nucleotides.

In one embodiment, the dsNA is cleaved endogenously in the cell by Dicer.

In another embodiment, the amount of the nucleic acid sufficient to reduce expression of the target gene is of 1 nanomolar or less, 200 picomolar or less, 100 picomolar or less, 50 picomolar or less, 20 picomolar or less, 10 picomolar or less, 5 picomolar or less, 2, picomolar or less and 1 picomolar or less in the environment of the cell.

In one embodiment, the dsNA possesses greater potency than a 21mer siRNA directed to the identical at least 19 nucleotides of the target AT3 mRNA in reducing target AT3 mRNA expression when assayed in vitro in a mammalian cell at an effective concentration in the environment of a cell of 1 nanomolar or less.

In an additional embodiment, the nucleic acid or dsNA is sufficiently complementary to the target AT3 mRNA sequence to reduce AT3 target mRNA expression by an amount (expressed by %) of at least 10%, at least 50%, at least 80-90%, at least 95%, at least 98%, or at least 99% when the double stranded nucleic acid is introduced into a mammalian cell.

In one embodiment, the first and second strands are joined by a chemical linker.

In another embodiment, the 3' terminus of the first strand and the 5' terminus of the second strand are joined by a chemical linker.

In an additional embodiment, a nucleotide of the second or first strand is substituted with a modified nucleotide that directs the orientation of Dicer cleavage.

In one embodiment, the nucleic acid, dsNA or hybridization complex possesses a deoxyribonucleotide, a dideoxyribonucleotide, an acyclonucleotide, a 3'-deoxyadenosine (cordycepin), a 3'-azido-3'-deoxythymidine (AZT), a 2',3'-dideoxyinosine (ddI), a 2',3'-dideoxy-3'-thiacytidine (3TC), a 2',3'-didehydro-2',3'-dideoxythymidine (d4T), a monophosphate nucleotide of 3'-azido-3'-deoxythymidine (AZT), a 2',3'-dideoxy-3'-thiacytidine (3TC) and a monophosphate nucleotide of 2',3'-didehydro-2',3'-dideoxythymidine (d4T), a 4-thiouracil, a 5-bromouracil, a 5-iodouracil, a 5-(3-aminoallyl)-uracil, a 2'-O-alkyl ribonucleotide, a 2'-O-methyl ribonucleotide, a 2'-amino ribonucleotide, a 2'-fluoro ribonucleotide, or a locked nucleic acid modified nucleotide.

In another embodiment, the nucleic acid, dsNA or hybridization complex includes a phosphonate, a phosphorothioate or a phosphotriester phosphate backbone modification.

In one embodiment, the nucleic acid, dsNA or hybridization complex includes a morpholino nucleic acid or a peptide nucleic acid (PNA).

In an additional embodiment, the nucleic acid, dsNA or hybridization complex is attached to a dynamic polyconjugate (DPC).

In one embodiment, the nucleic acid, dsNA or hybridization complex is administered with a DPC, where the dsNA and DPC are optionally not attached.

In another embodiment, the nucleic acid, dsNA or hybridization complex is attached to a GalNAc moiety, a cholesterol and/or a cholesterol targeting ligand.

Another aspect of the invention provides a composition of the following:

a dsNA possessing first and second nucleic acid strands, where the first strand is 15-35 nucleotides in length and the second strand of the dsNA is 19-35 nucleotides in length, where the second oligonucleotide strand is sufficiently complementary to a target AT3 mRNA sequence of SEQ ID NOs: 1921-2304 along at least 19 nucleotides of the second oligonucleotide strand length to reduce AT3 target mRNA expression when the double stranded nucleic acid is introduced into a mammalian cell;

a dsNA possessing first and second nucleic acid strands, where the first strand is 15-35 nucleotides in length and the second strand of the dsNA is 19-35 nucleotides in length, where the second oligonucleotide strand is sufficiently complementary to a target AT3 mRNA sequence of SEQ ID NOs: 1921-2304 along at least 19 nucleotides of the second oligonucleotide strand length to reduce AT3 target mRNA expression, and where, starting from the 5' end of the AT3 mRNA sequence of SEQ ID NOs: 1921-2304 (position 1), mammalian Ago2 cleaves the mRNA at a site between positions 9 and 10 of the sequence, when the double stranded nucleic acid is introduced into a mammalian cell;

a dsNA molecule, consisting of: (a) a sense region and an antisense region, where the sense region and the antisense region together form a duplex region consisting of 25-35 base pairs and the antisense region includes a sequence that is the complement of a sequence of SEQ ID NOs: 1921-2304; and (b) from zero to two 3' overhang regions, where each overhang region is six or fewer nucleotides in length, and where, starting from the 5' end of the AT3 mRNA sequence of SEQ ID NOs: 1921-2304 (position 1), mammalian Ago2 cleaves the mRNA at a site between positions 9 and 10 of the sequence, when the double stranded nucleic acid is introduced into a mammalian cell;

a dsNA possessing first and second nucleic acid strands and a duplex region of at least 25 base pairs, where the first strand is 25-34 nucleotides in length and the second strand of the dsNA is 26-35 nucleotides in length and includes 1-5 single-stranded nucleotides at its 3' terminus, where the second oligonucleotide strand is sufficiently complementary to a target AT3 mRNA sequence of SEQ ID NOs: 1921-2304 along at least 19 nucleotides of the second oligonucleotide strand length to reduce AT3 target gene expression when the double stranded nucleic acid is introduced into a mammalian cell;

a dsNA possessing first and second nucleic acid strands and a duplex region of at least 25 base pairs, where the first strand is 25-34 nucleotides in length and the second strand of the dsNA is 26-35 nucleotides in length and includes 1-5 single-stranded nucleotides at its 3' terminus, where the 3' terminus of the first oligonucleotide strand and the 5' terminus of the second oligonucleotide strand form a blunt end, and the second oligonucleotide strand is sufficiently complementary to a target AT3 sequence of SEQ ID NOs: 1921-2304 along at least 19 nucleotides of the second oligonucleotide strand length to reduce AT3 mRNA expression when the double stranded nucleic acid is introduced into a mammalian cell;

a nucleic acid possessing an oligonucleotide strand of 19-35 nucleotides in length, where the oligonucleotide strand is sufficiently complementary to a target AT3 mRNA sequence of SEQ ID NOs: 1921-2304 along at least 19 nucleotides of the oligonucleotide strand length to reduce AT3 target mRNA expression when the nucleic acid is introduced into a mammalian cell;

a nucleic acid possessing an oligonucleotide strand of 15-35 nucleotides in length, where the oligonucleotide strand is hybridizable to a target AT3 mRNA sequence of SEQ ID NOs: 1921-2304 along at least 15 nucleotides of the oligonucleotide strand length;

a dsNA possessing first and second nucleic acid strands possessing RNA, where the first strand is 15-35 nucleotides in length and the second strand of the dsNA is 19-35 nucleotides in length, where the second oligonucleotide strand is hybridizable to a target AT3 mRNA sequence of SEQ ID NOs: 1921-2304 along at least 15 nucleotides of the second oligonucleotide strand length;

a dsNA possessing first and second nucleic acid strands possessing RNA, where the first strand is 15-35 nucleotides in length and the second strand of the dsNA is at least 35 nucleotides in length and optionally includes a sequence of at least 25 nucleotides in length of SEQ ID NOs: 385-768, where the second oligonucleotide strand is sufficiently complementary to a target AT3 mRNA sequence of SEQ ID NOs: 1921-2304 along at least 15 nucleotides of the second oligonucleotide strand length to reduce AT3 target mRNA expression when the double stranded nucleic acid is introduced into a mammalian cell;

a dsNA possessing a first oligonucleotide strand having a 5' terminus and a 3' terminus and a second oligonucleotide strand having a 5' terminus and a 3' terminus, where the first strand is 25 to 53 nucleotide residues in length, where starting from the first nucleotide (position 1) at the 5' terminus of the first strand, positions 1 to 23 of the first strand are ribonucleotides or modified ribonucleotides; the second strand is 27 to 53 nucleotide residues in length and includes 23 consecutive ribonucleotides or modified ribonucleotides that base pair with the ribonucleotides or ribonucleotides of positions 1 to 23 of the first strand to form a duplex; the 5' terminus of the first strand and the 3' terminus of the second strand form a structure of a blunt end, a 1-6 nucleotide 5' overhang and a 1-6 nucleotide 3' overhang; the 3' terminus of the first strand and the 5' terminus of the second strand form a structure of a blunt end, a 1-6 nucleotide 5' overhang and a 1-6 nucleotide 3' overhang; at least one of positions 24 to the 3' terminal nucleotide residue of the first strand is a deoxyribonucleotide or modified ribonucleotide that optionally base pairs with a deoxyribonucleotide of the second strand; and the second strand is sufficiently complementary to a target AT3 mRNA sequence of SEQ ID NOs: 1921-2304 along at least 15 nucleotides of the second oligonucleotide strand length to reduce AT3 target mRNA expression when the double stranded nucleic acid is introduced into a mammalian cell;

a dsNA possessing a first oligonucleotide strand having a 5' terminus and a 3' terminus and a second oligonucleotide strand having a 5' terminus and a 3' terminus, where the second strand is 27 to 53 nucleotide residues in length, where starting from the first nucleotide (position 1) at the 5' terminus of the second strand, positions 1 to 23 of the second strand are ribonucleotides or modified ribonucleotides; the first strand is 25 to 53 nucleotide residues in length and includes 23 consecutive ribonucleotides or modified ribonucleotides that base pair sufficiently with the ribonucleotides of positions 1 to 23 of the second strand to form a duplex; at least one of positions 24 to the 3' terminal nucleotide residue of the second strand is a deoxyribonucleotide or modified ribonucleotide, optionally that base pairs with a deoxyribonucleotide or modified ribonucleotide of the first strand; and the second strand is sufficiently complementary to a target AT3 mRNA sequence of SEQ ID NOs: 1921-2304 along at least 15 nucleotides of the second oligonucleotide strand length to reduce AT3 target mRNA expression when the double stranded nucleic acid is introduced into a mammalian cell;

a dsNA possessing a first oligonucleotide strand having a 5' terminus and a 3' terminus and a second oligonucleotide strand having a 5' terminus and a 3' terminus, where each of the 5' termini has a 5' terminal nucleotide and each of the 3' termini has a 3' terminal nucleotide, where the first strand (or the second strand) is 25-30 nucleotide residues in length, where starting from the 5' terminal nucleotide (position 1) positions 1 to 23 of the first strand (or the second strand) include at least 8 ribonucleotides; the second strand (or the first strand) is 36-66 nucleotide residues in length and, starting from the 3' terminal nucleotide, includes at least 8 ribonucleotides in the positions paired with positions 1-23 of the first strand to form a duplex; where at least the 3' terminal nucleotide of the second strand (or the first strand) is unpaired with the first strand (or the second strand), and up to 6 consecutive 3' terminal nucleotides are unpaired with the first strand (or the second strand), thereby forming a 3' single stranded overhang of 1-6 nucleotides; where the 5' terminus of the second strand (or the first strand) includes from 10-30 consecutive nucleotides which are unpaired with the first strand (or the second strand), thereby forming a 10-30 nucleotide single stranded 5' overhang; where at least the first strand (or the second strand) 5' terminal and 3' terminal nucleotides are base paired with nucleotides of the second strand (or first strand) when the first and second strands are aligned for maximum complementarity, thereby forming a substantially duplexed region between the first and second strands; and the second strand is sufficiently complementary to a target RNA along at least 19 ribonucleotides of the second strand length to reduce target gene expression when the double stranded nucleic acid is introduced into a mammalian cell;

a dsNA possessing a first oligonucleotide strand having a 5' terminus and a 3' terminus and a second oligonucleotide strand having a 5' terminus and a 3' terminus, where each of the 5' termini has a 5' terminal nucleotide and each of the 3' termini has a 3' terminal nucleotide, where the first strand is 25-35 nucleotide residues in length, where starting from the 5' terminal nucleotide (position 1) positions 1 to 25 of the second strand include at least 8 ribonucleotides; the second strand is 30-66 nucleotide residues in length and, starting from the 3' terminal nucleotide, includes at least 8 ribonucleotides in the positions paired with positions 1-25 of the first strand to form a duplex; where the 5' terminus of the second strand includes from 5-35 consecutive nucleotides which are unpaired with the first strand, thereby forming a 5-35 nucleotide single stranded 5' overhang; where at least the first strand 5' terminal and 3' terminal nucleotides are base paired with nucleotides of the second strand when the first and second strands are aligned for maximum complementarity, thereby forming a substantially duplexed region between the first and second strands; and the second strand is sufficiently complementary to a target AT3 mRNA sequence of SEQ ID NOs: 1921-2304 along at least 15 nucleotides of the second oligonucleotide strand length to reduce AT3 target mRNA expression when the double stranded nucleic acid is introduced into a mammalian cell;

a dsNA possessing a first oligonucleotide strand having a 5' terminus and a 3' terminus and a second oligonucleotide strand having a 5' terminus and a 3' terminus, where each of the 5' termini has a 5' terminal nucleotide and each of the 3' termini has a 3' terminal nucleotide, where the second strand is 19-30 nucleotide residues in length and optionally 25-30 nucleotide residues in length, where starting from the 5' terminal nucleotide (position 1) positions 1 to 17 (optionally positions 1 to 23) of the second strand include at least 8 ribonucleotides; the first strand is 24-66 nucleotide residues in length (optionally 30-66 nucleotide residues in length) and, starting from the 3' terminal nucleotide, includes at least 8 ribonucleotides in the positions paired with positions 1 to 17 (optionally positions 1 to 23) of the second strand to form a duplex; where the 3' terminus of the first strand and the 5' terminus of the second strand comprise a structure of a blunt end, a 3' overhang and a 5' overhang, optionally where the overhang is 1-6 nucleotides in length; where the 5' terminus of the first strand includes from 5-35 consecutive nucleotides which are unpaired with the second strand, thereby forming a 5-35 nucleotide single-stranded 5' overhang; where at least the second strand 5' terminal and 3' terminal nucleotides are base paired with nucleotides of the first strand when the first and second strands are aligned for maximum complementarity, thereby forming a substantially duplexed region between the first and second strands; and the second strand is sufficiently complementary to a target AT3 mRNA sequence of SEQ ID NOs: 1921-2304 along at least 15 nucleotides of the second oligonucleotide strand length to reduce AT3 target mRNA expression when the double stranded nucleic acid is introduced into a mammalian cell;

a dsNA possessing a first strand and a second strand, where the first strand and the second strand form a duplex region of 19-25 nucleotides in length, where the first strand includes a 3' region that extends beyond the first strand-second strand duplex region and includes a tetraloop, and the dsNA further includes a discontinuity between the 3' terminus of the first strand and the 5' terminus of the second strand, and the first or second strand is sufficiently complementary to a target AT3 mRNA sequence of SEQ ID NOs: 1921-2304 along at least 15 nucleotides of the first or second strand length to reduce AT3 target mRNA expression when the dsNA is introduced into a mammalian cell;

a dsNA possessing a first oligonucleotide strand having a 5' terminus and a 3' terminus and a second oligonucleotide strand having a 5' terminus and a 3' terminus, where each of the 5' termini has a 5' terminal nucleotide and each of the 3' termini has a 3' terminal nucleotide, where the first oligonucleotide strand is 25-53 nucleotides in length and the second is oligonucleotide strand is 25-53 nucleotides in length, and where the dsNA is sufficiently highly modified to substantially prevent dicer cleavage of the dsNA, optionally where the dsNA is cleaved by non-dicer nucleases to yield one or more 19-23 nucleotide strand length dsNAs capable of reducing LDH mRNA expression in a mammalian cell;

an in vivo hybridization complex within a cell of an exogenous nucleic acid sequence and a target AT3 mRNA sequence of SEQ ID NOs: 1921-2304; and an in vitro hybridization complex within a cell of an exogenous nucleic acid sequence and a target AT3 mRNA sequence of SEQ ID NOs: 1921-2304.

In one embodiment, a dsNA of the invention possesses a duplex region of at least 25 base pairs, where the dsNA possesses greater potency than a 21mer siRNA directed to the identical at least 19 nucleotides of the target AT3 mRNA in reducing target AT3 mRNA expression when assayed in vitro in a mammalian cell at an effective concentration in the environment of a cell of 1 nanomolar or less.

In another embodiment, the dsNA of the invention has a duplex region of at least 25 base pairs, where the dsNA possesses greater potency than a 21mer siRNA directed to the identical at least 19 nucleotides of the target AT3 mRNA in reducing target AT3 mRNA expression when assayed in vitro in a mammalian cell at a concentration of 1 nanomolar, 200 picomolar, 100 picomolar, 50 picomolar, 20 picomolar, 10 picomolar, 5 picomolar, 2, picomolar and 1 picomolar.

In an additional embodiment, the dsNA of the invention possesses four or fewer mismatched nucleic acid residues with respect to the target AT3 mRNA sequence along 15 or 19 consecutive nucleotides of the at least 15 or 19 nucleotides of the second oligonucleotide strand when the 15 or 19 consecutive nucleotides of the second oligonucleotide are aligned for maximum complementarity with the target AT3 mRNA sequence.

In another embodiment, the dsNA of the invention possesses three or fewer mismatched nucleic acid residues with respect to the target AT3 mRNA sequence along 15 or 19 consecutive nucleotides of the at least 15 or 19 nucleotides of the second oligonucleotide strand when the 15 or 19 consecutive nucleotides of the second oligonucleotide are aligned for maximum complementarity with the target AT3 mRNA sequence.

Optionally, the dsNA of the invention possesses two or fewer mismatched nucleic acid residues with respect to the target AT3 mRNA sequence along 15 or 19 consecutive nucleotides of the at least 15 or 19 nucleotides of the second oligonucleotide strand when the 15 or 19 consecutive nucleotides of the second oligonucleotide are aligned for maximum complementarity with the target AT3 mRNA sequence.

In certain embodiments, the dsNA of the invention possesses one mismatched nucleic acid residue with respect to the target AT3 mRNA sequence along 15 or 19 consecutive nucleotides of the at least 15 or 19 nucleotides of the second oligonucleotide strand when the 15 or 19 consecutive nucleotides of the second oligonucleotide are aligned for maximum complementarity with the target AT3 mRNA sequence.

In one embodiment, 15 or 19 consecutive nucleotides of the at least 15 or 19 nucleotides of the second oligonucleotide strand are completely complementary to the target AT3 mRNA sequence when the 15 or 19 consecutive nucleotides of the second oligonucleotide are aligned for maximum complementarity with the target AT3 mRNA sequence.

Optionally, a nucleic acid, dsNA or hybridization complex of the invention is isolated.

Another aspect of the invention provides a method for reducing expression of a target AT3 gene in a mammalian cell involving contacting a mammalian cell in vitro with a nucleic acid, dsNA or hybridization complex of the invention in an amount sufficient to reduce expression of a target AT3 mRNA in the cell.

Optionally, target AT3 mRNA expression is reduced by an amount (expressed by %) of at least 10%, at least 50% and at least 80-90%.

In one embodiment, AT3 mRNA levels are reduced by an amount (expressed by %) of at least 90% at least 8 days after the cell is contacted with the dsNA.

In another embodiment, AT3 mRNA levels are reduced by an amount (expressed by %) of at least 70% at least 10 days after the cell is contacted with the dsNA.

A further aspect of the invention provides a method for reducing expression of a target AT3 mRNA in a mammal possessing administering a nucleic acid, dsNA or hybridization complex of the invention to a mammal in an amount sufficient to reduce expression of a target AT3 mRNA in the mammal.

In one embodiment, the nucleic acid, dsNA or hybridization complex is formulated in a lipid nanoparticle (LNP).

In another embodiment, the nucleic acid, dsNA or hybridization complex is administered at a dosage of 1 microgram to 5 milligrams per kilogram of the mammal per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, and 0.1 to 2.5 micrograms per kilogram.

In certain embodiments, the nucleic acid, dsNA or hybridization complex possesses greater potency than 21mer siRNAs directed to the identical at least 19 nucleotides of the target AT3 mRNA in reducing target AT3 mRNA expression when assayed in vitro in a mammalian cell at an effective concentration in the environment of a cell of 1 nanomolar or less.

In one embodiment, AT3 mRNA levels are reduced in a tissue of the mammal by an amount (expressed by %) of at least 70% at least 3 days after the dsNA is administered to the mammal.

Optionally, the tissue is blood or bone marrow tissue.

In certain embodiments, the administering step involves intravenous injection, intramuscular injection, intraperitoneal injection, infusion, subcutaneous injection, transdermal, aerosol, rectal, vaginal, topical, oral or inhaled delivery.

Another aspect of the invention provides a method for treating or preventing a disease or disorder in a subject that involves administering to the subject an amount of a nucleic acid, dsNA or hybridization complex of the invention in an amount sufficient to treat or prevent the disease or disorder in the subject.

In one embodiment, the disease or disorder is hemophilia.

Optionally, the subject is human.

A further aspect of the invention provides a formulation that includes the nucleic acid, dsNA or hybridization complex of the invention, where the nucleic acid, dsNA or hybridization complex is present in an amount effective to reduce target AT3 mRNA levels when the nucleic acid, dsNA or hybridization complex is introduced into a mammalian cell in vitro by an amount (expressed by %) of at least 10%, at least 50% and at least 80-90%.

In one embodiment, the effective amount is of 1 nanomolar or less, 200 picomolar or less, 100 picomolar or less, 50 picomolar or less, 20 picomolar or less, 10 picomolar or less, 5 picomolar or less, 2, picomolar or less and 1 picomolar or less in the environment of the cell.

In another embodiment, the nucleic acid, dsNA or hybridization complex is present in an amount effective to reduce target AT3 mRNA levels when the nucleic acid, dsNA or hybridization complex is introduced into a cell of a mammalian subject by an amount (expressed by %) of at least 10%, at least 50% and at least 80-90%.

Optionally, the effective amount is a dosage of 1 microgram to 5 milligrams per kilogram of the subject per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, or 0.1 to 2.5 micrograms per kilogram.

In another embodiment, the nucleic acid, dsNA or hybridization complex possesses greater potency than an 21mer siRNA directed to the identical at least 19 nucleotides of the target AT3 mRNA in reducing target AT3 mRNA levels when assayed in vitro in a mammalian cell at an effective concentration in the environment of a cell of 1 nanomolar or less.

A further aspect of the invention provides a mammalian cell containing the nucleic acid, dsNA or hybridization complex of the invention.

Another aspect of the invention provides a pharmaceutical composition that includes the nucleic acid, dsNA or hybridization complex of the invention and a pharmaceutically acceptable carrier.

An additional aspect of the invention provides a kit including the nucleic acid, dsNA or hybridization complex of the invention and instructions for its use.

A further aspect of the invention provides a composition possessing AT3 inhibitory activity consisting essentially of a nucleic acid, dsNA or hybridization complex of the invention.

BRIEF DESCRIPTION OF THE DRAWINGS

FIGS. 2E and 2F) in human (HepG2) and mouse (H36.12J) cells, respectively. FIGS. 2G and 2H show results for mouse unique DsiRNAs. FIGS. 2I and 2J show a compilation of knockdown data in both human and mouse cells, presented in relation to Homo sapiens AT3 gene locations, while FIGS. 2K and 2L present composite knockdown data in both human and mouse cells, presented in relation to Mus musculus Serpinc1/AT3 gene locations. For each DsiRNA tested in human or mouse cells, two independent qPCR amplicons were assayed (amplicons "1643-1764" and "4318-4322" in humans, "2253-2374" and "4717-4813" in mice).

FIGS. 3A to 3H show histograms of human and mouse AT3 inhibitory efficacies observed for indicated DsiRNAs. "P1" indicates phase 1 (primary screen), while "P2" indicates phase 2. In phase 1, DsiRNAs were tested at 1 nM in the environment of HepG2 cells (human cell assays; FIGS. 3A to 3D) or mouse H36.12J cells (H36.12J cell assays; FIGS. 3E to 3H). In phase 2, DsiRNAs were tested at 1 nM and 0.1 nM (in duplicate) in the environment of HepG2 cells or mouse H36.12J cells. Individual bars represent average human (FIGS. 3A to 3D) or mouse (FIGS. 3E to 3H) AT3 levels observed in triplicate, with standard errors shown. Mouse AT3 levels were normalized to HPRT and Rpl23 levels.

FIG. 5 shows the structure of tetraloop-containing Dicer substrate "AT3-179-TL".

DETAILED DESCRIPTION OF THE INVENTION

Figure 1:
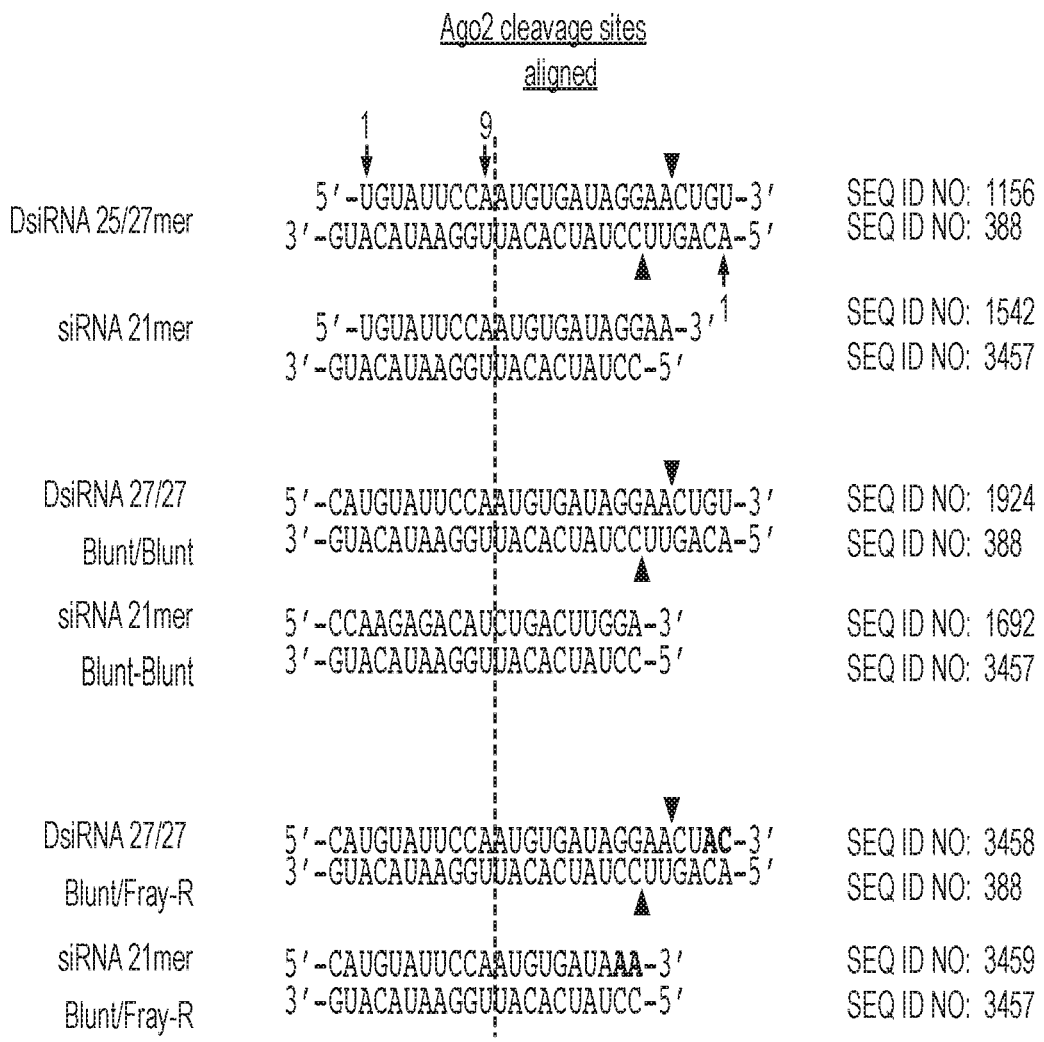
FIG. 1 shows the structures of exemplary DsiRNA agents of the invention targeting a site in the AT3 RNA referred to herein as the "AT3-145" target site. UPPER case=unmodified RNA, lower case=DNA, Bold=mismatch base pair nucleotides; arrowheads indicate projected Dicer enzyme cleavage sites; dashed line indicates sense strand (top strand) sequences corresponding to the projected Argonaute 2 (Ago2) cleavage site within the targeted AT3 sequence.
Figure 2A:
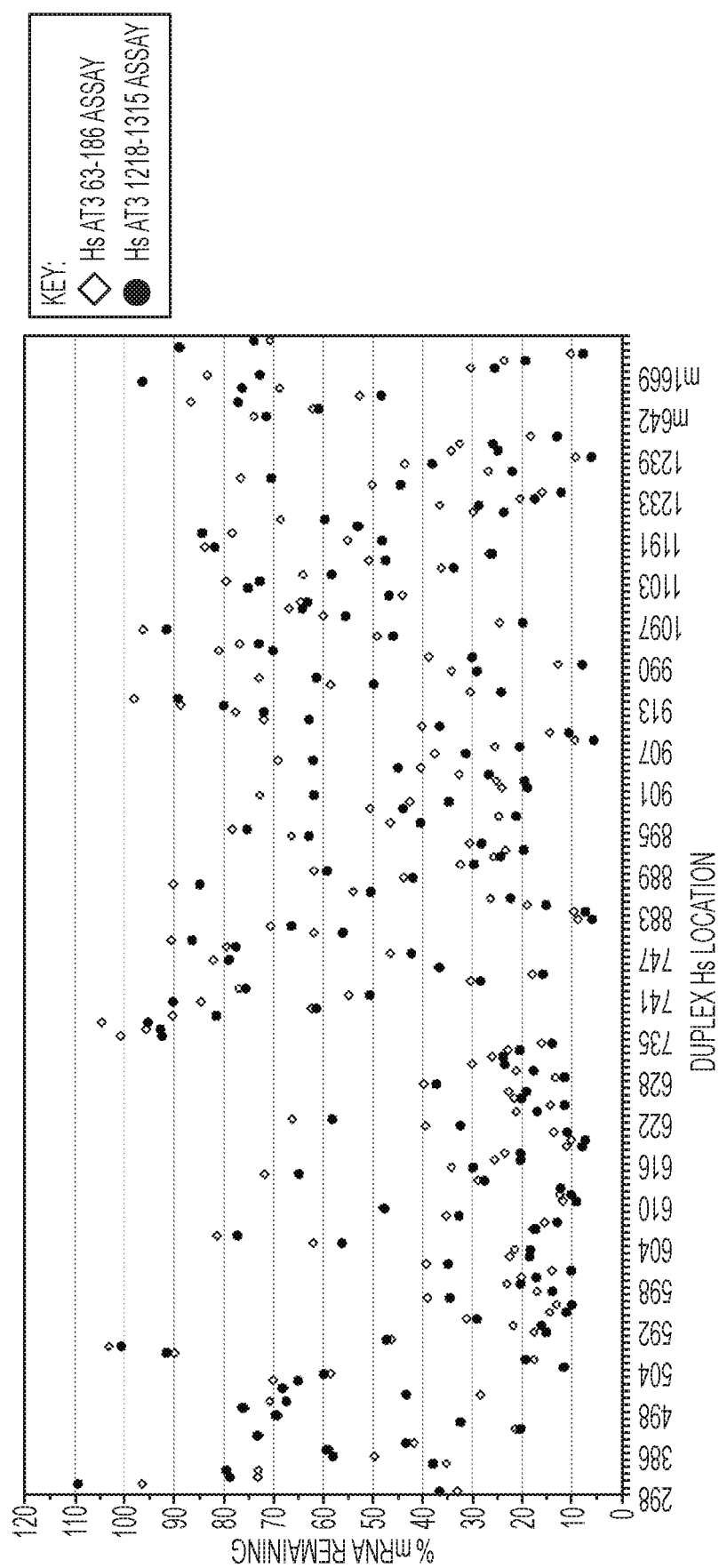
FIGS. 2A to 2L present primary screen data showing DsiRNA-mediated knockdown of human AT3 (FIGS. 2A and 2B show results for human-mouse common DsiRNAs, while FIGS. 2C and 2D show results for human unique DsiRNAs) and mouse Serpinc1/AT3 (corresponding to human AT3.
Figure 2B:
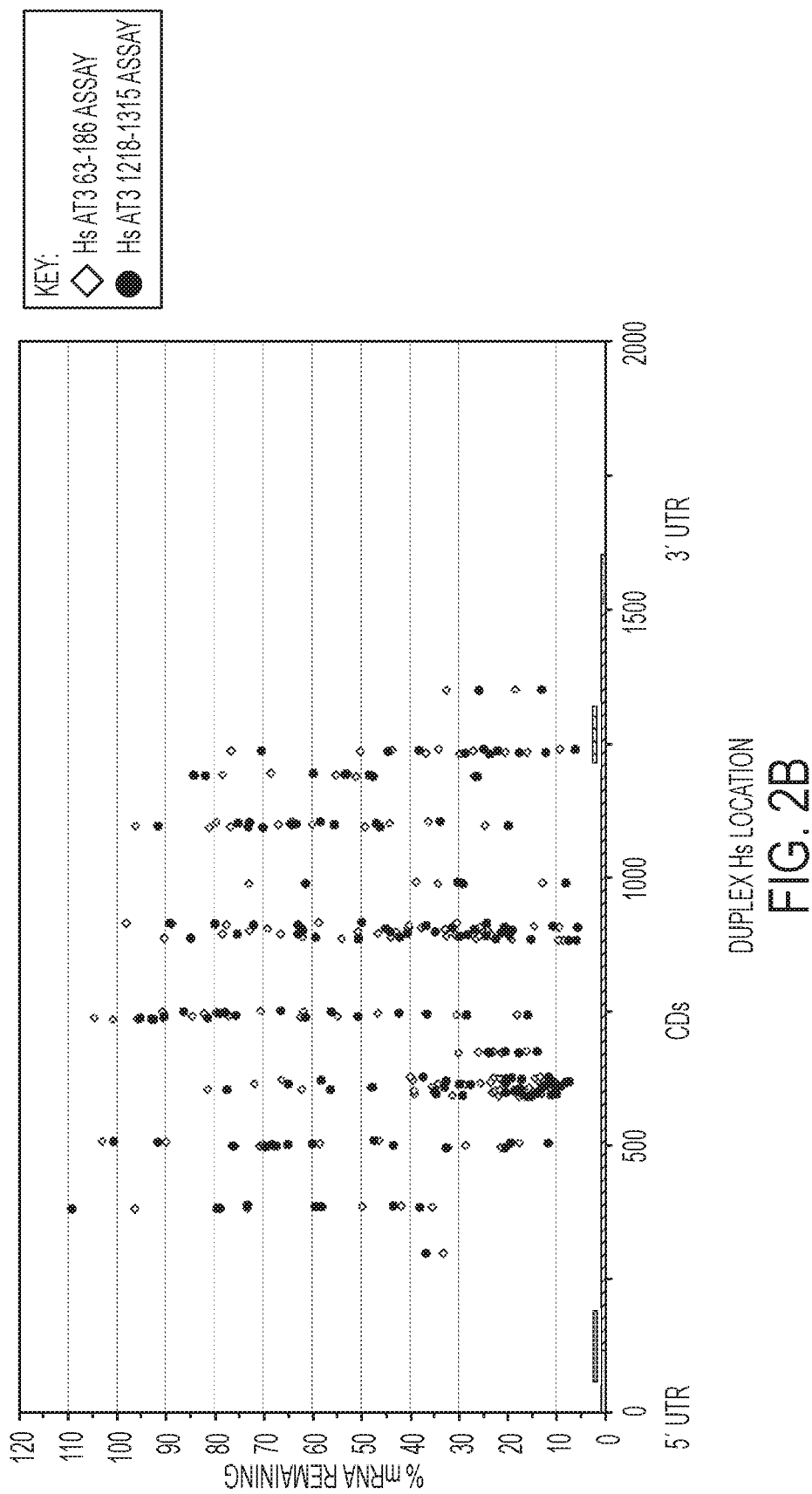
Figure 2C:
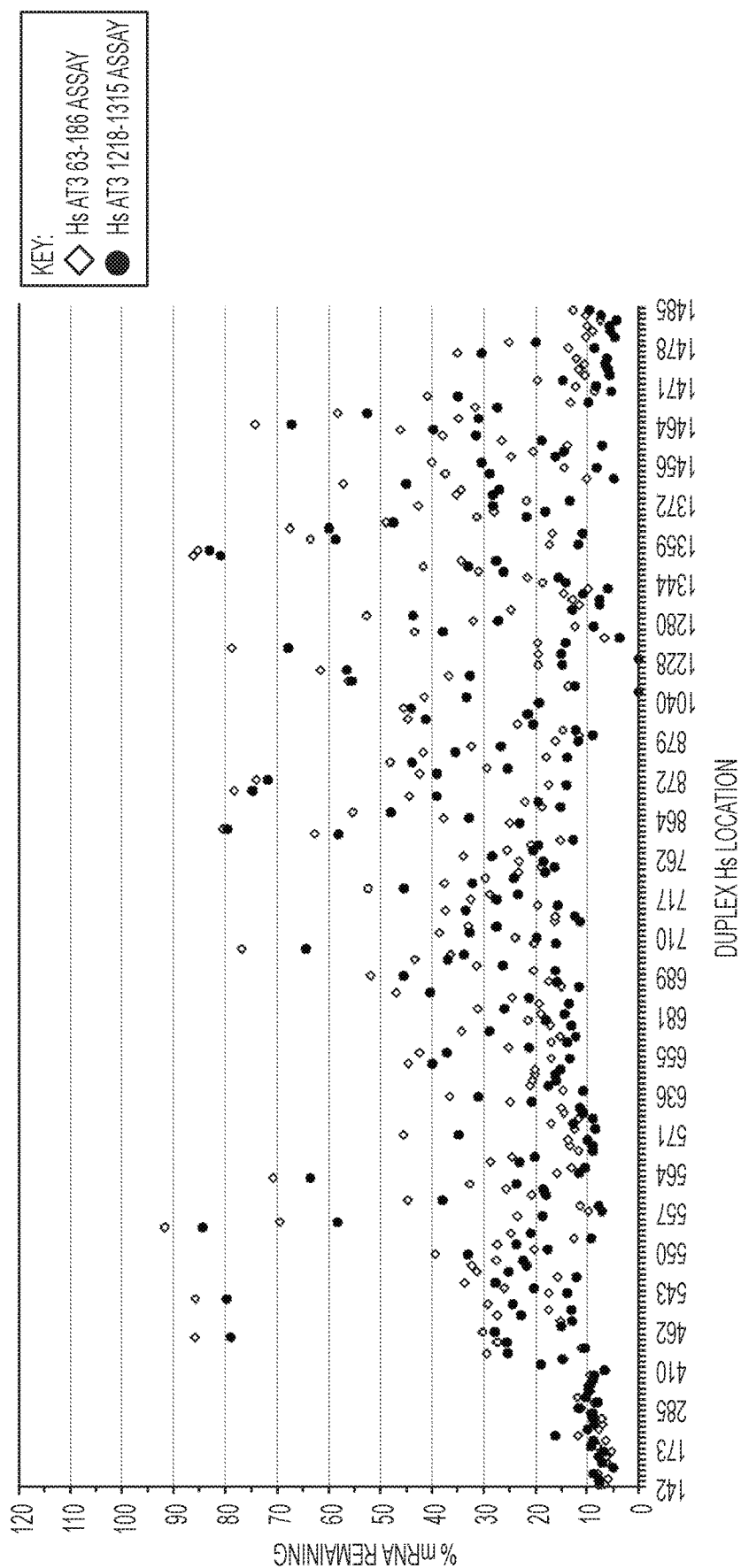
Figure 2D:
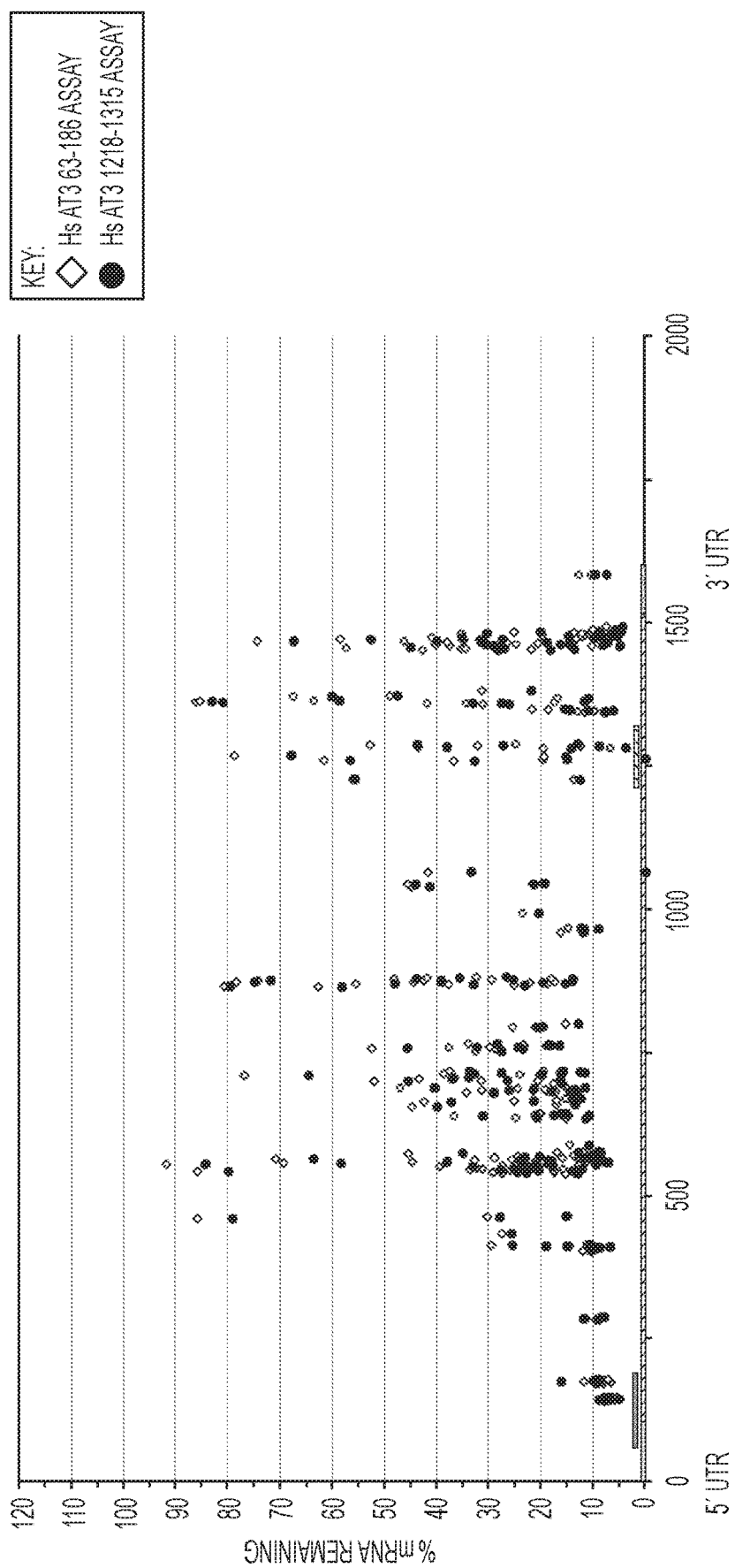
Figure 2E:
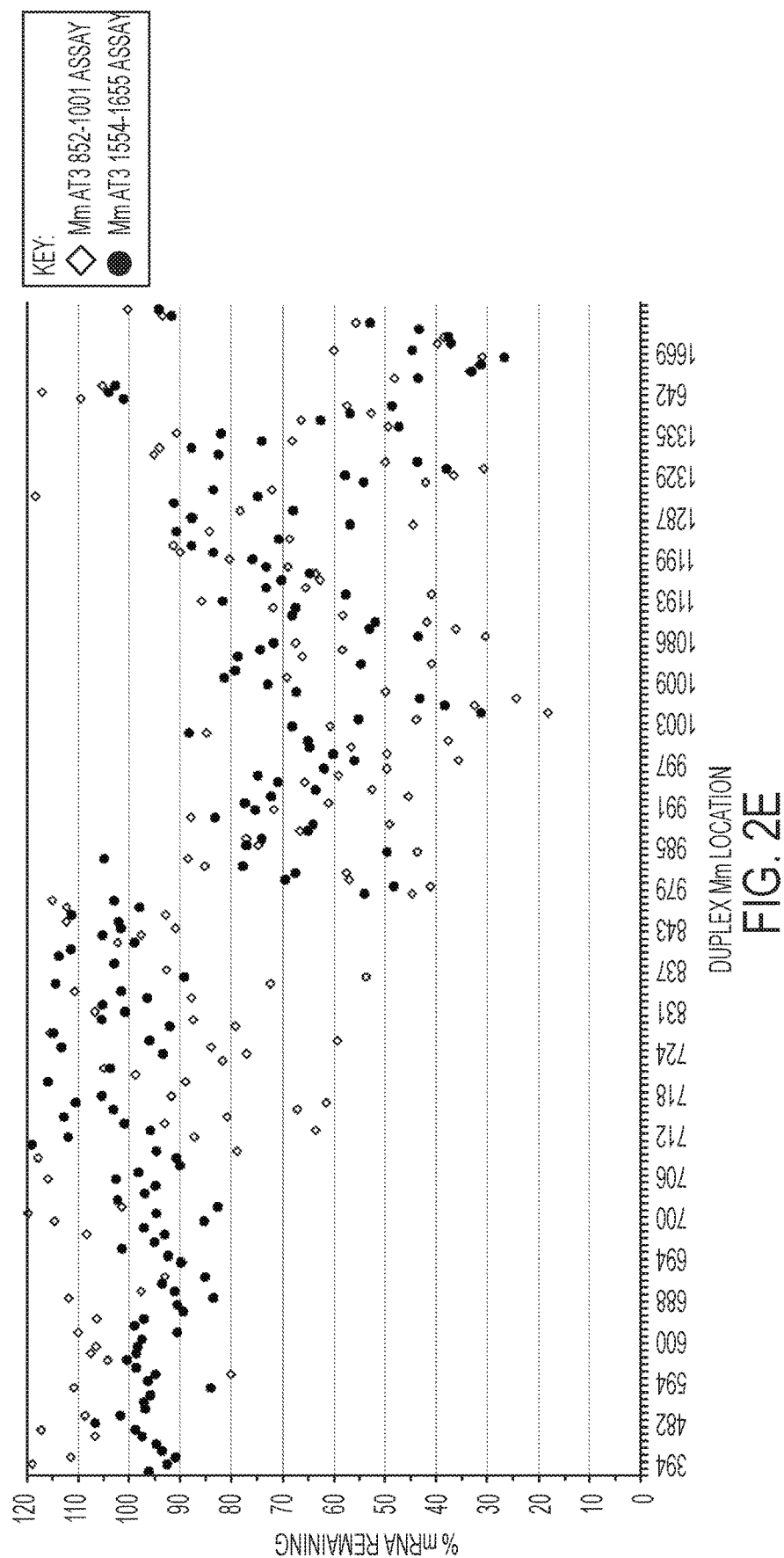
Figure 2F:
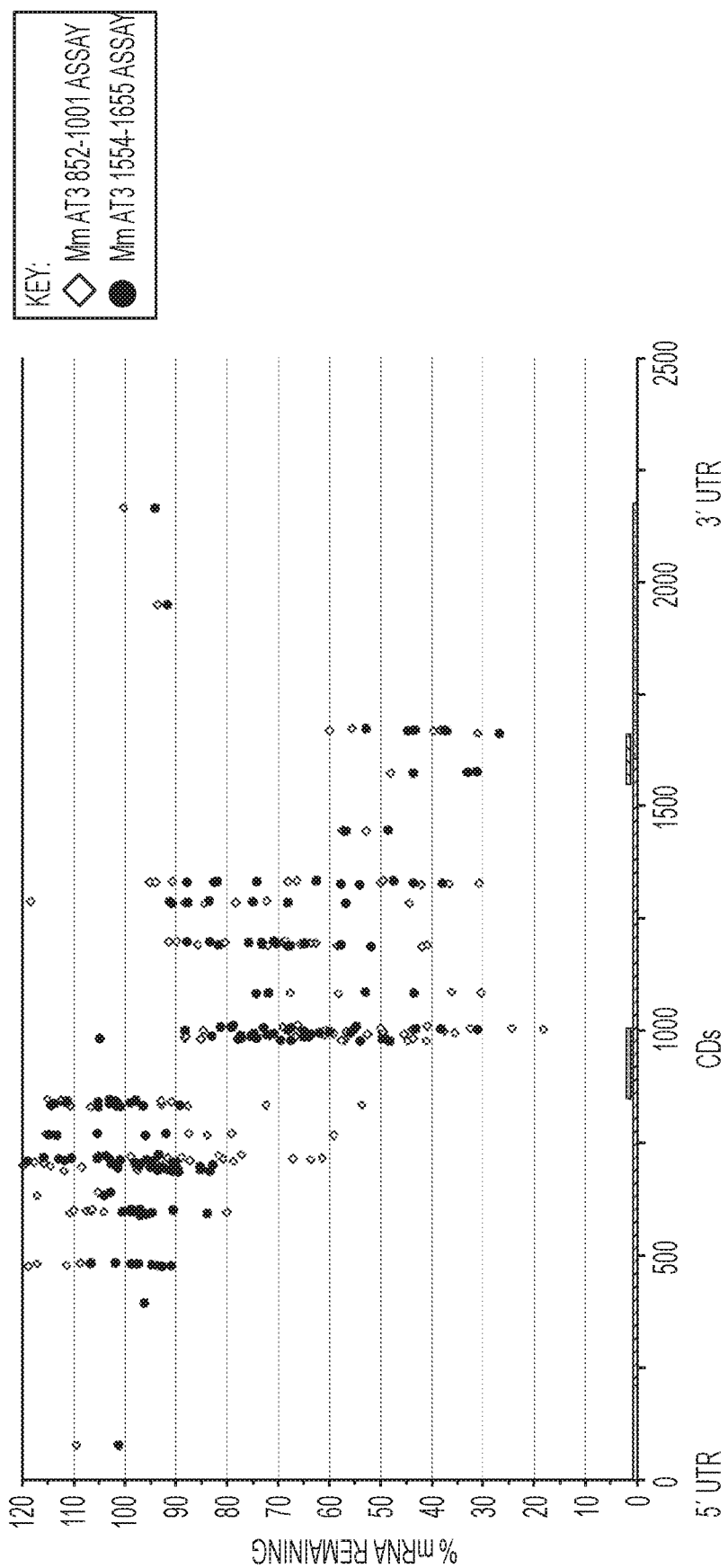
Figure 2G:
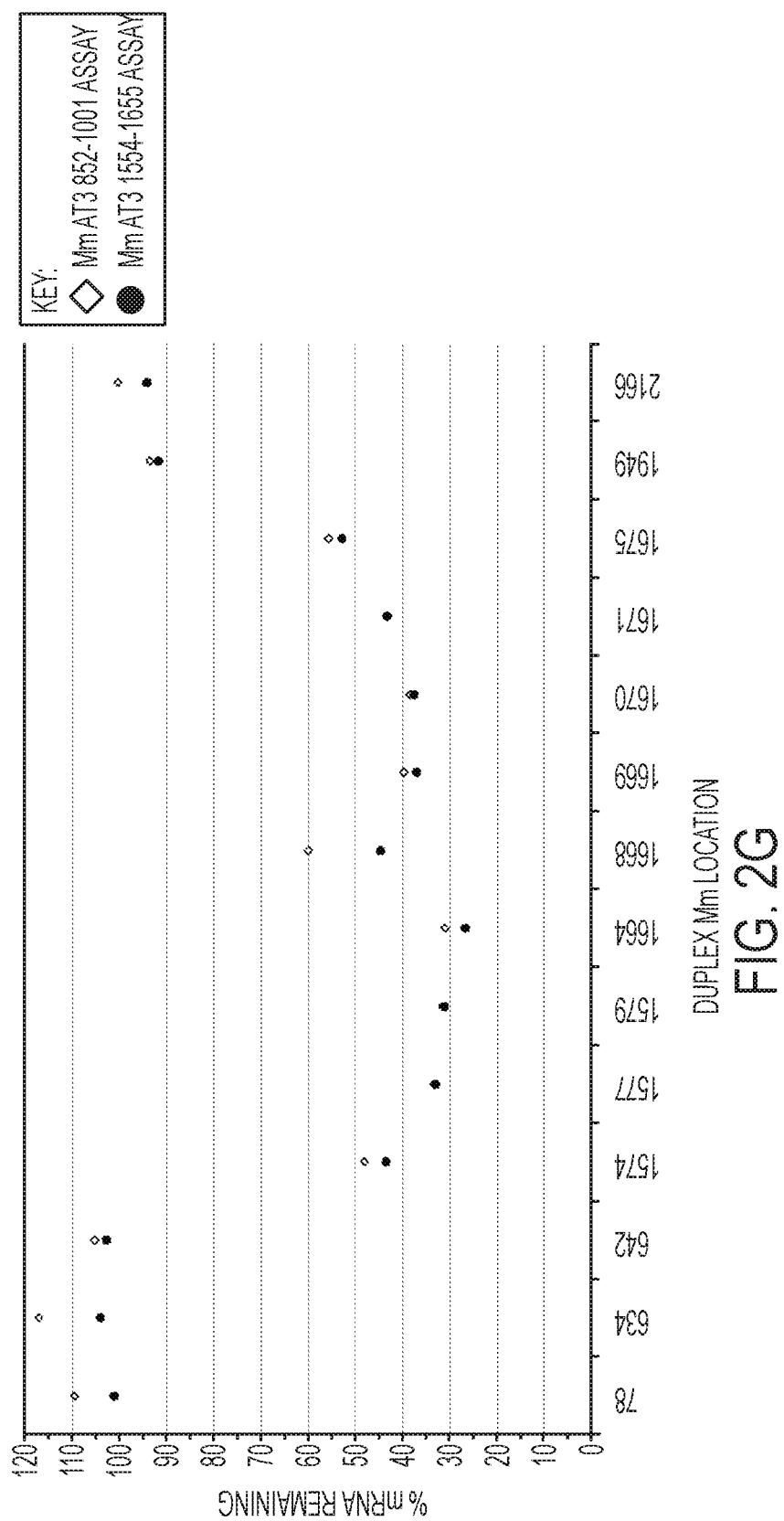
Figure 2H:
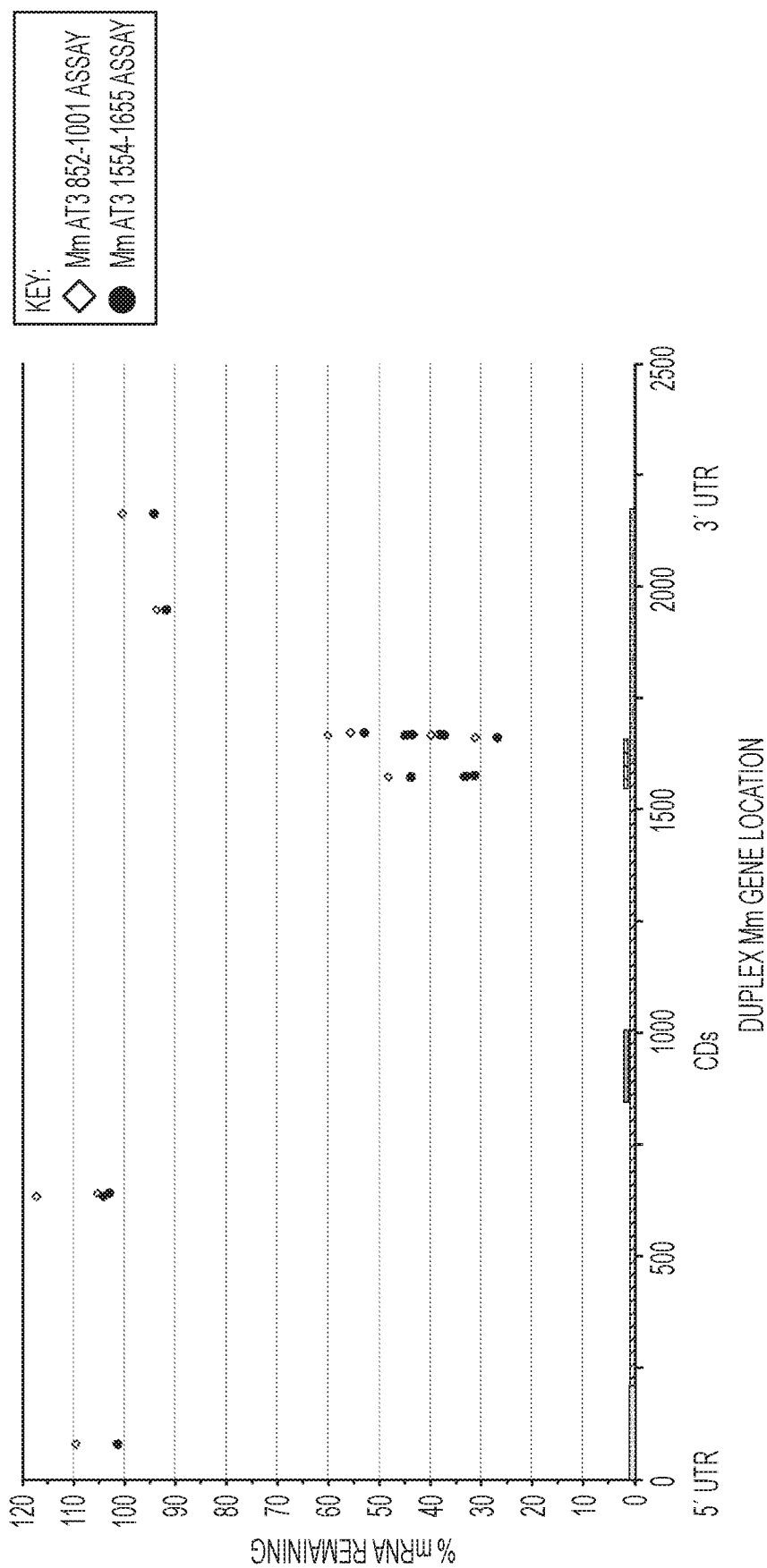
Figure 2I:
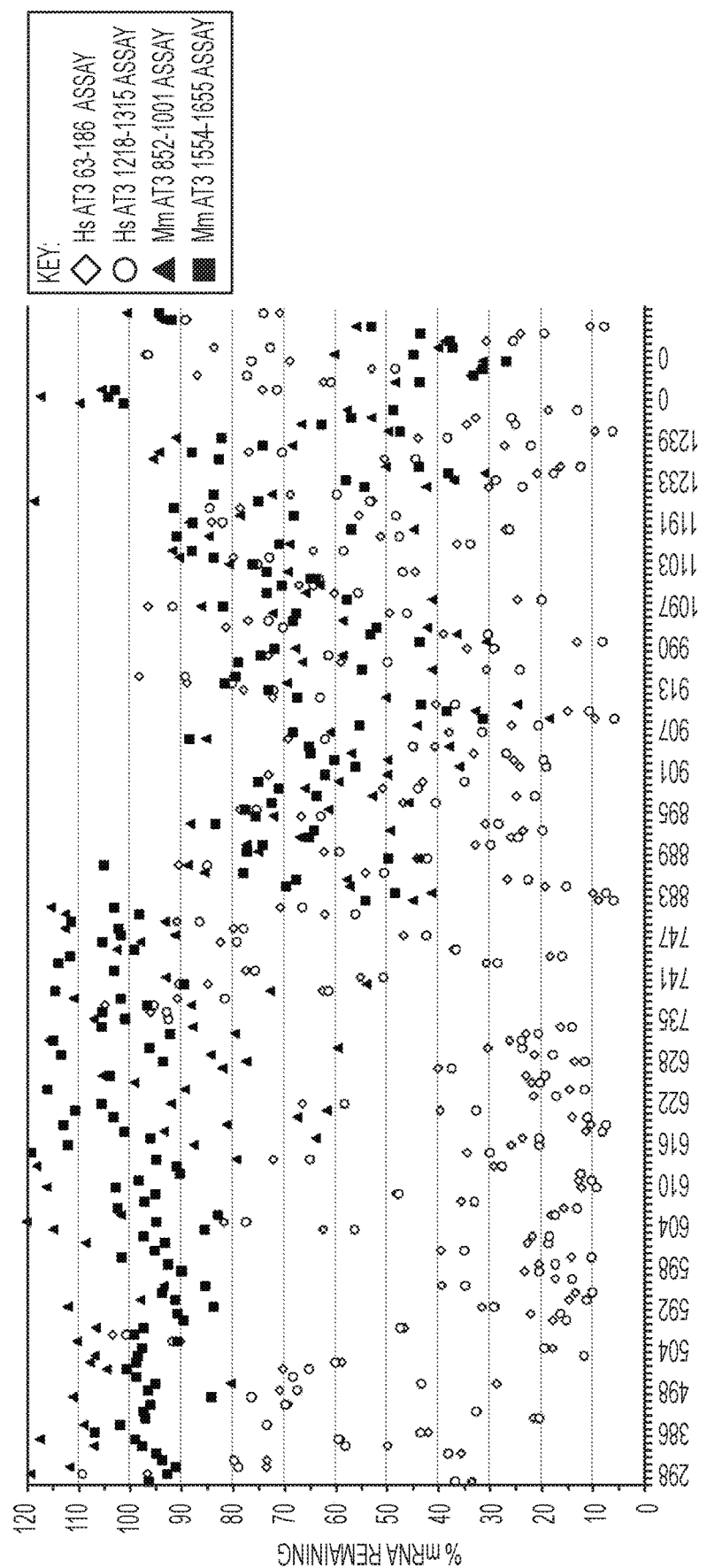
Figure 2J:
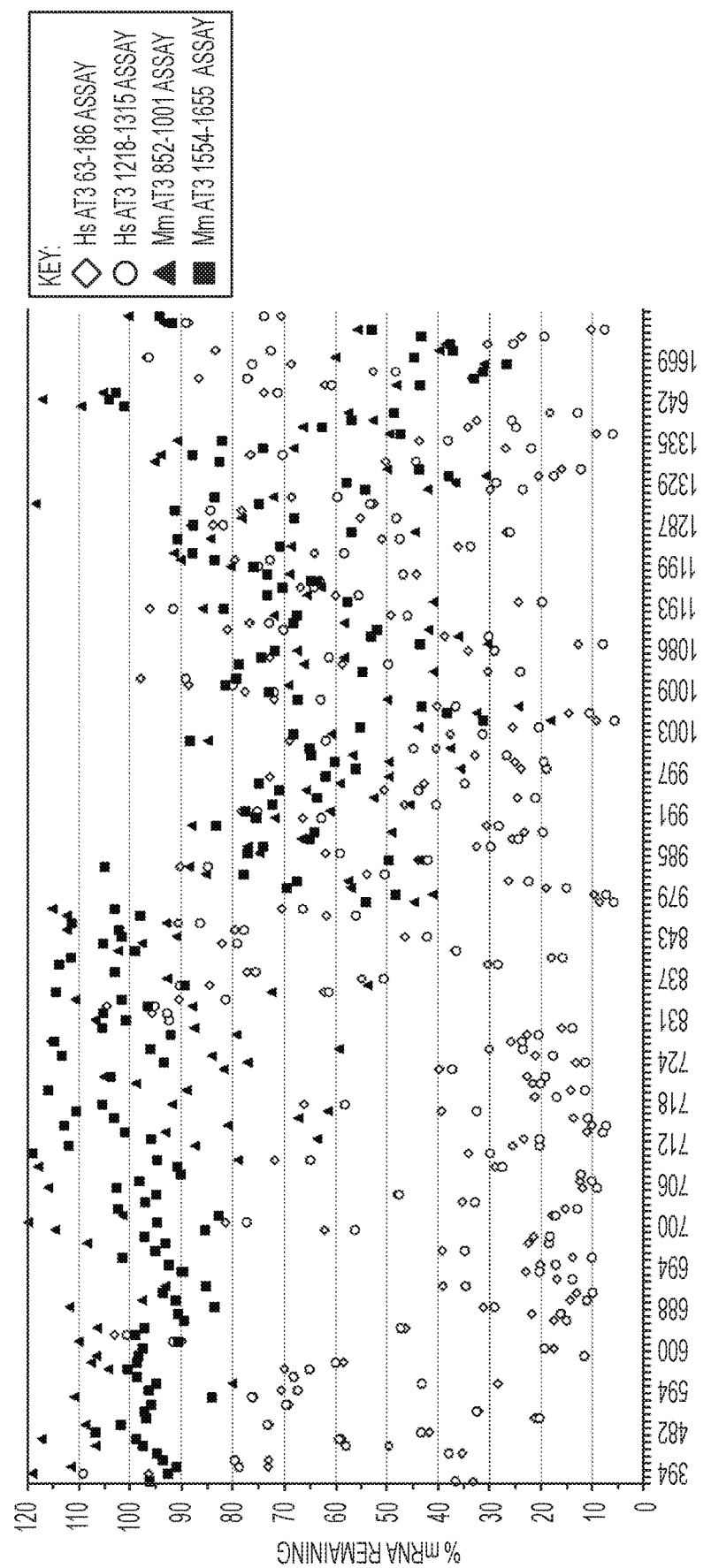
Figure 2K:
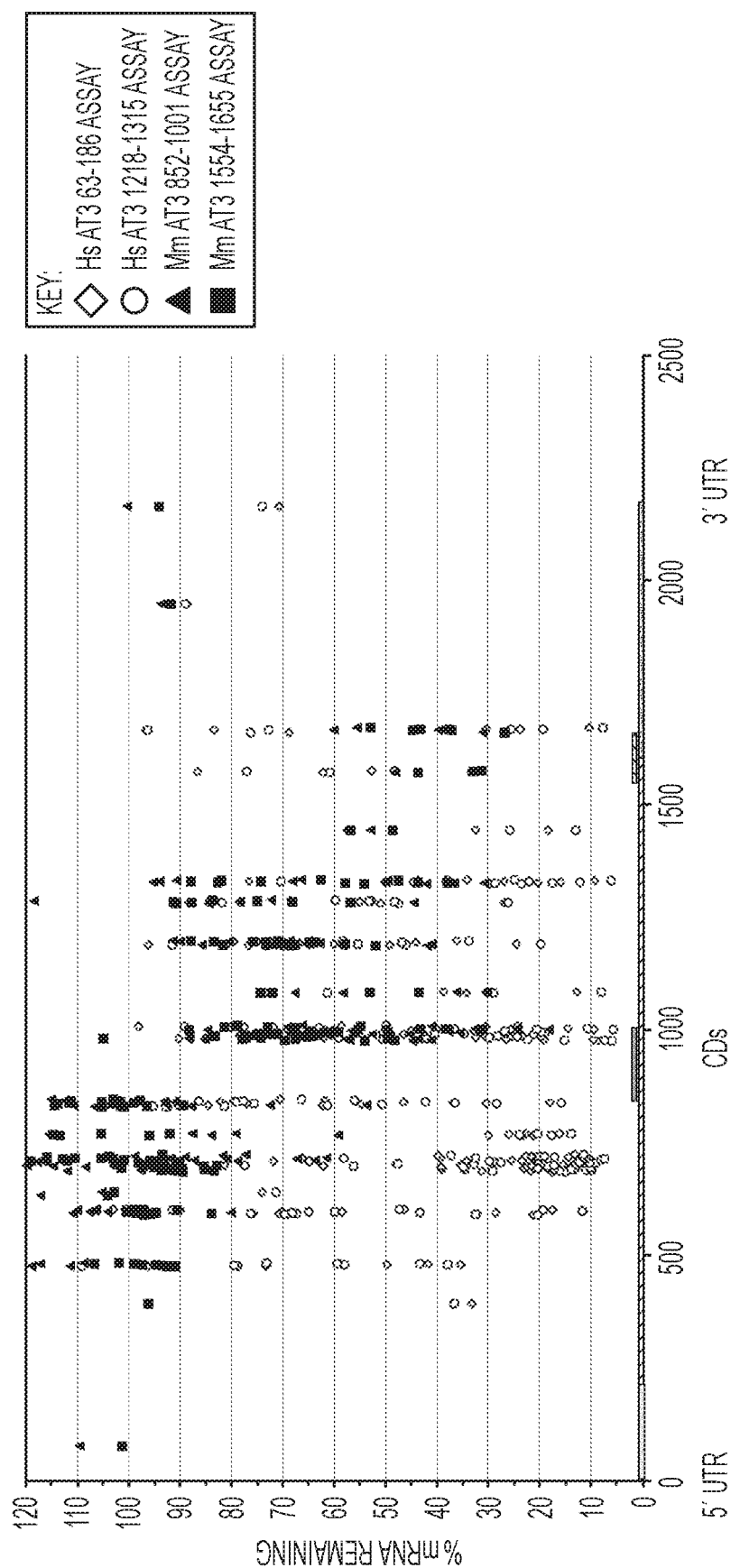
Figure 2L:
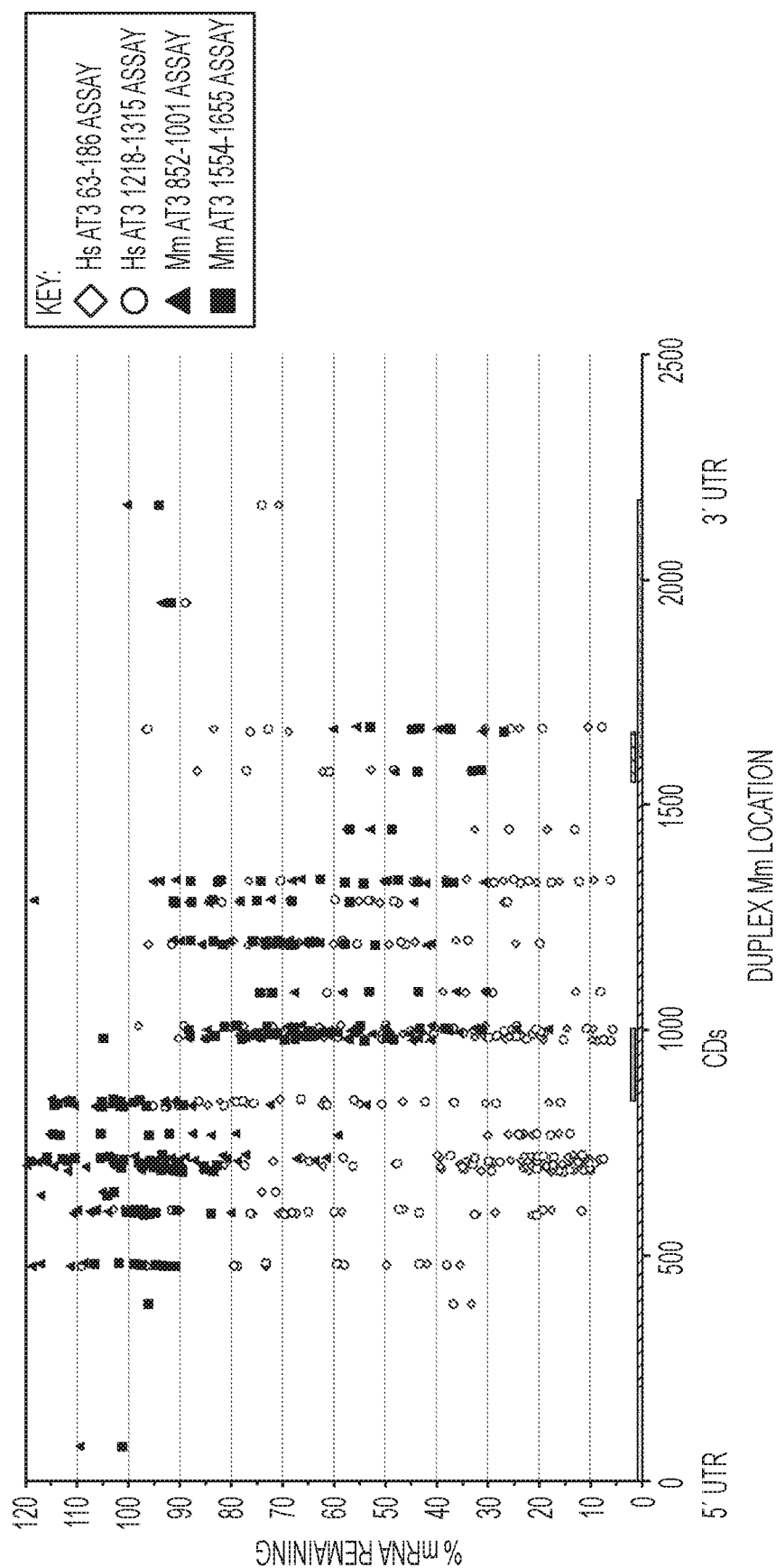
Figure 3A:
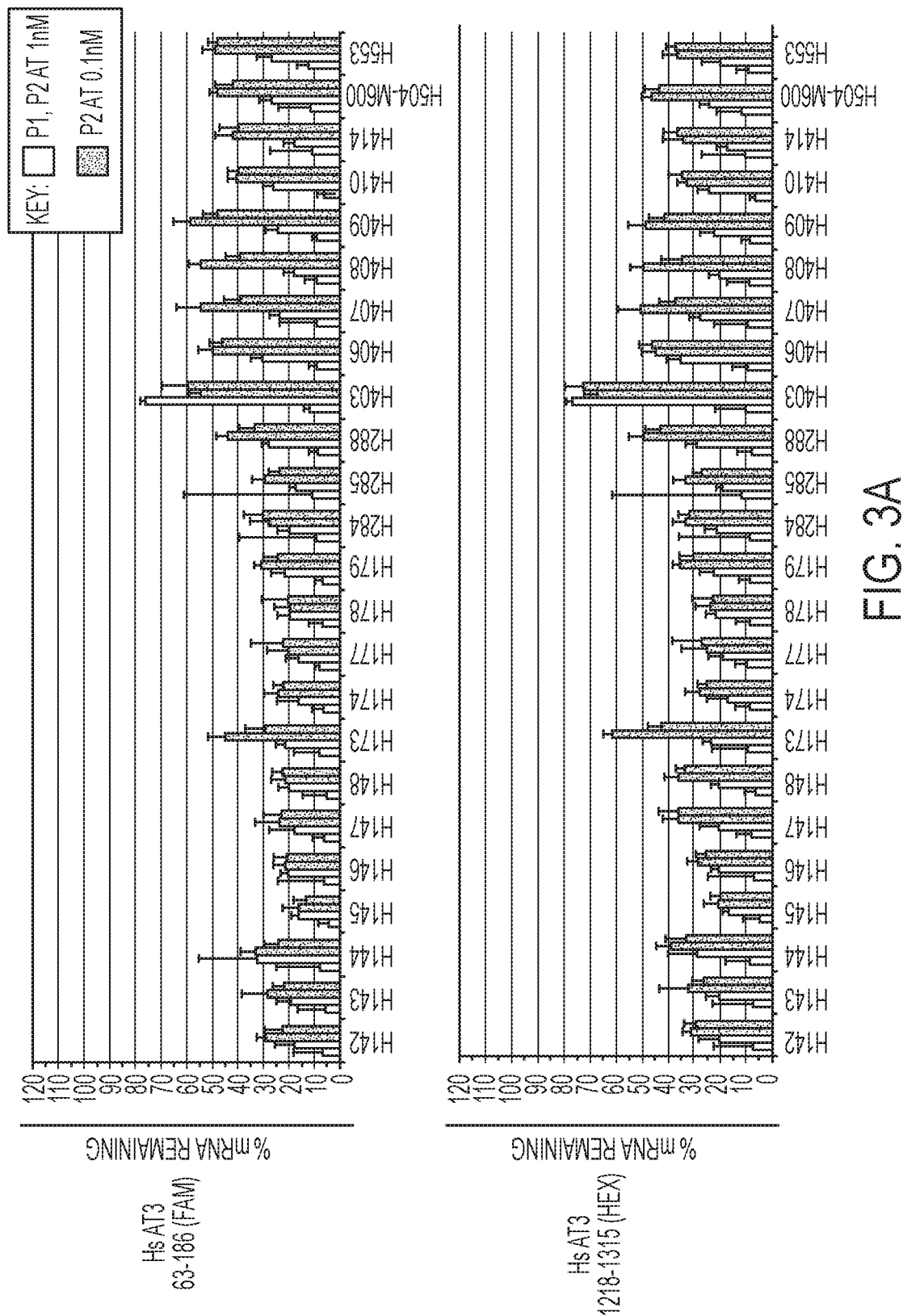
Figure 3B:
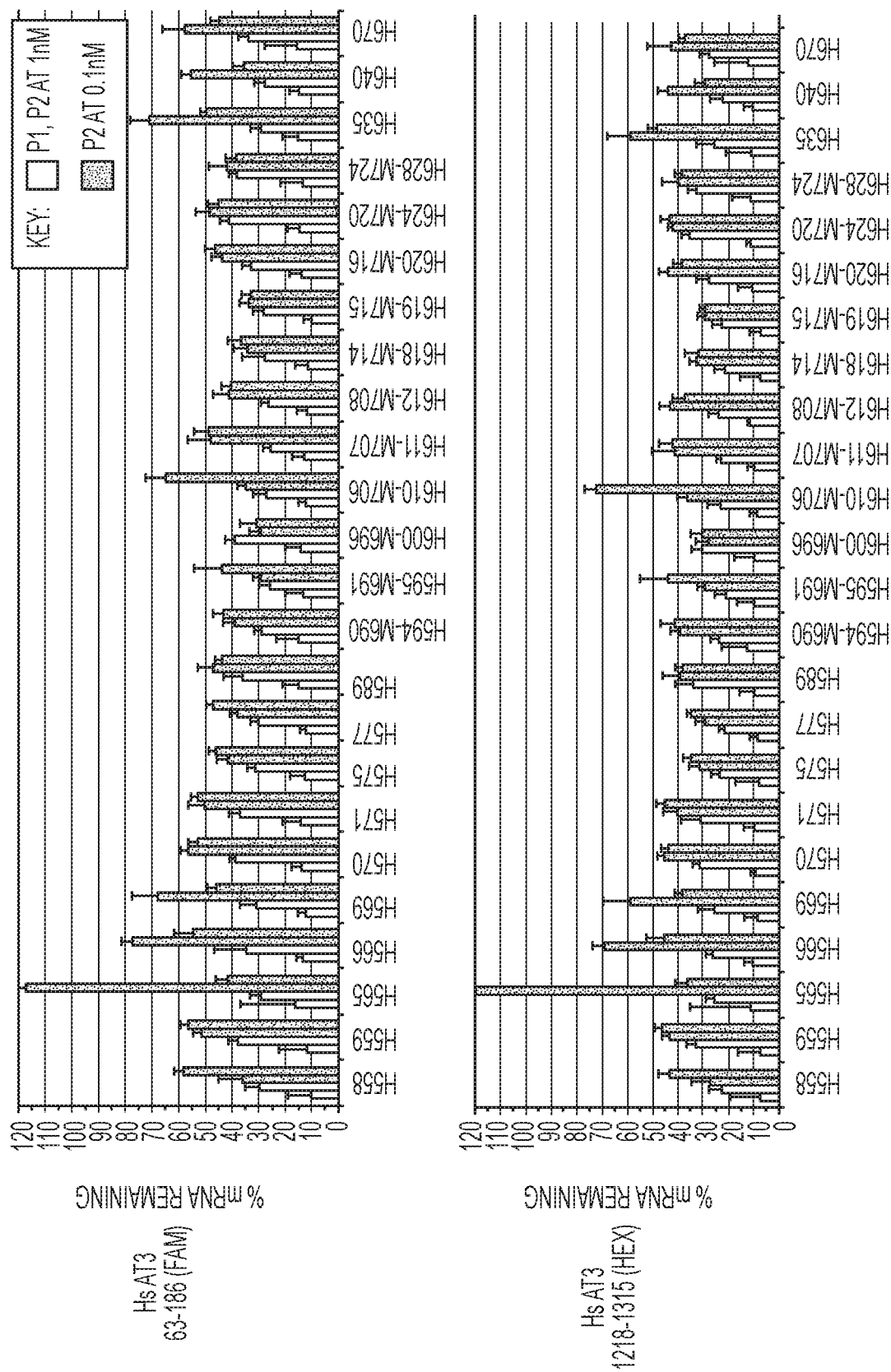
Figure 3D:
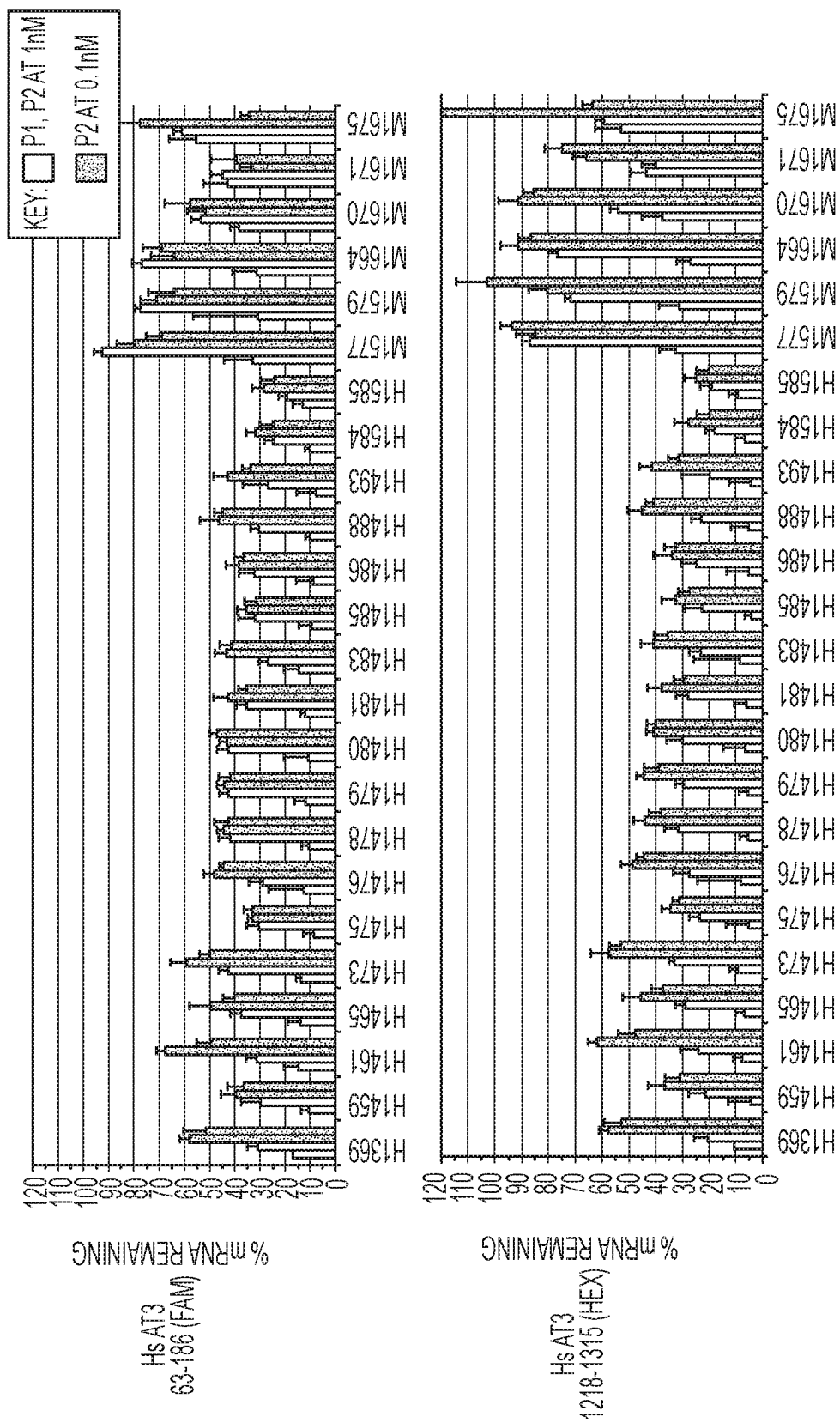
Figure 3E:
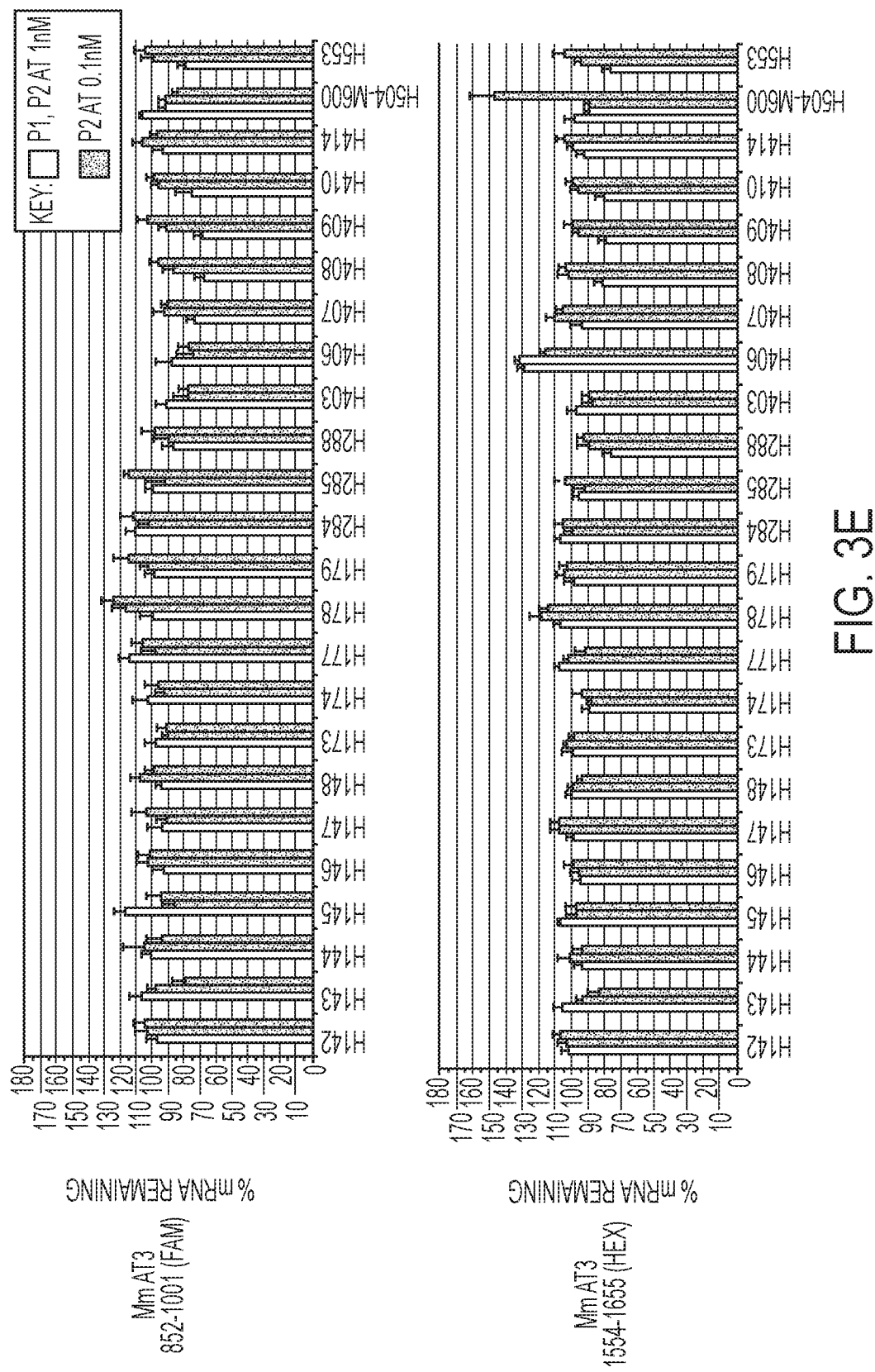
Figure 3F:
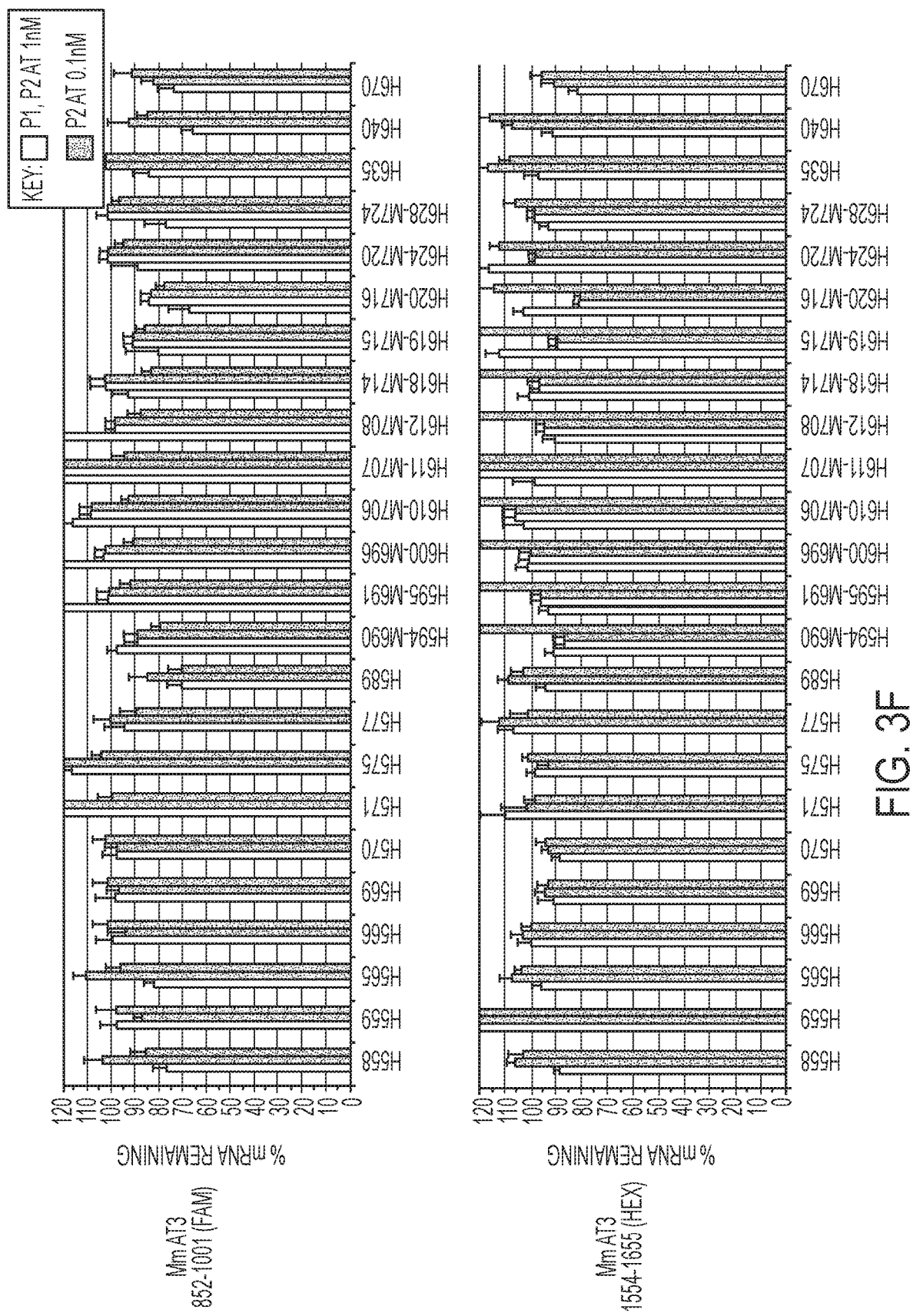
Figure 3G:
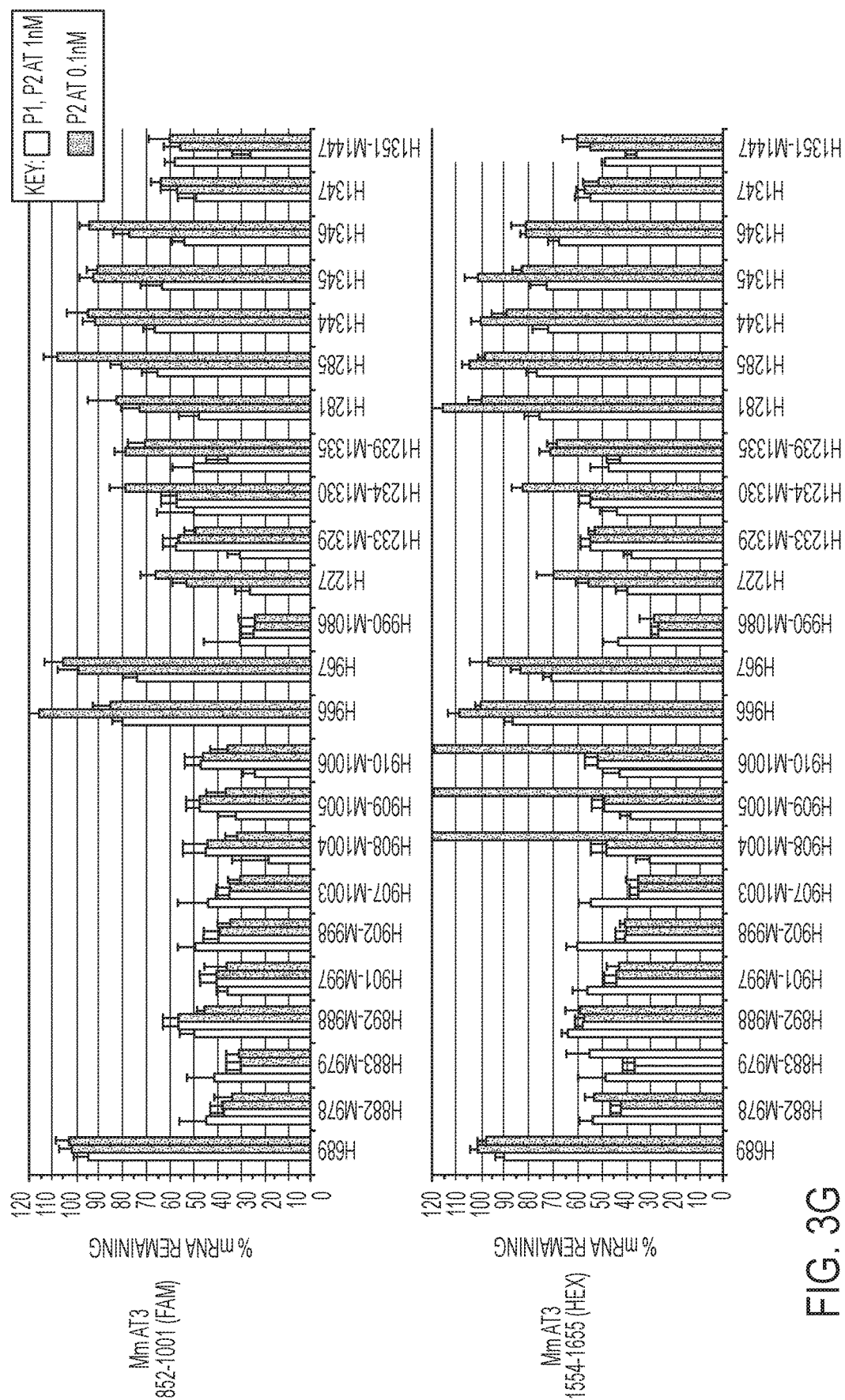
Figure 3H:
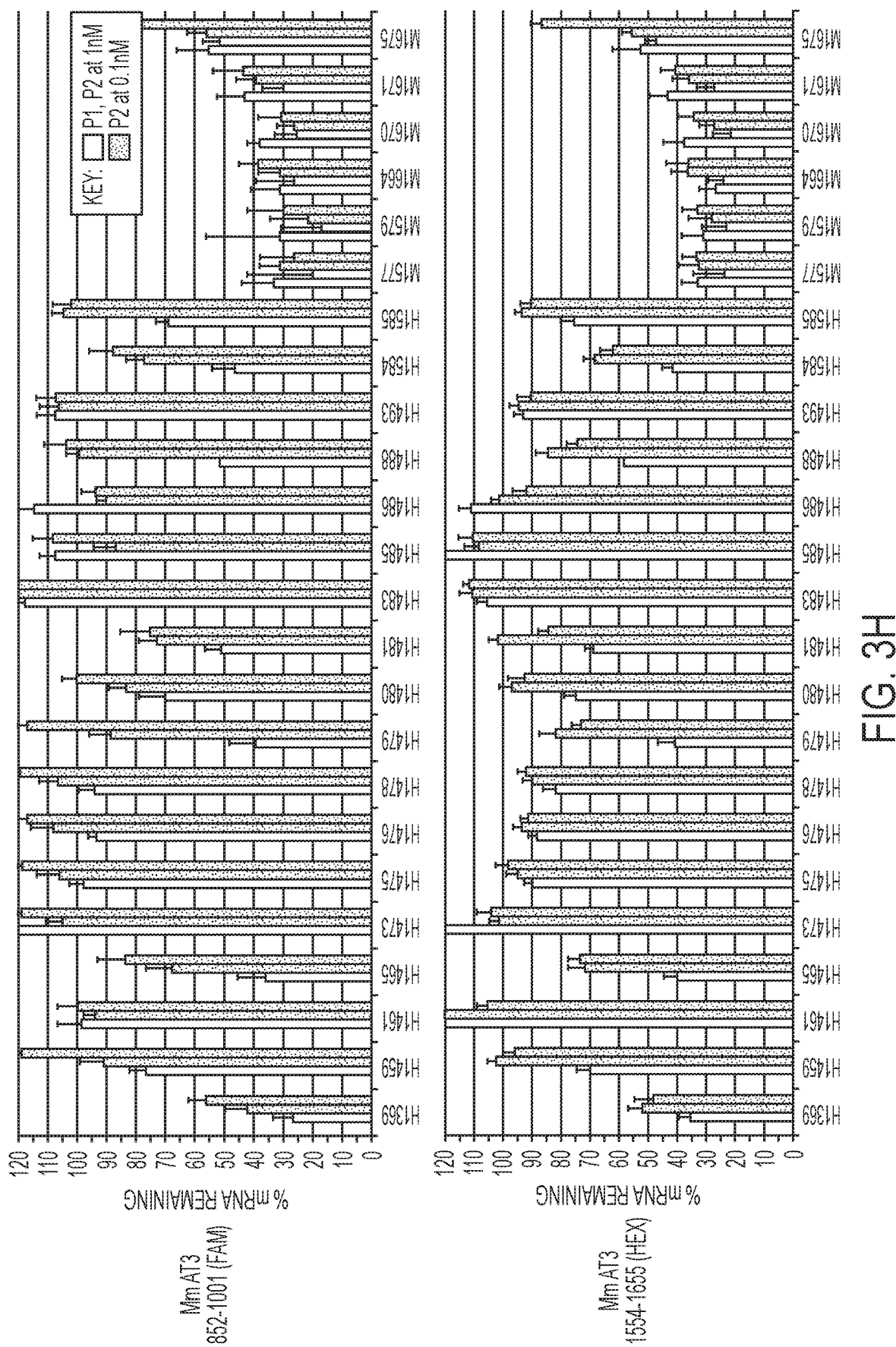
Figure 4A:
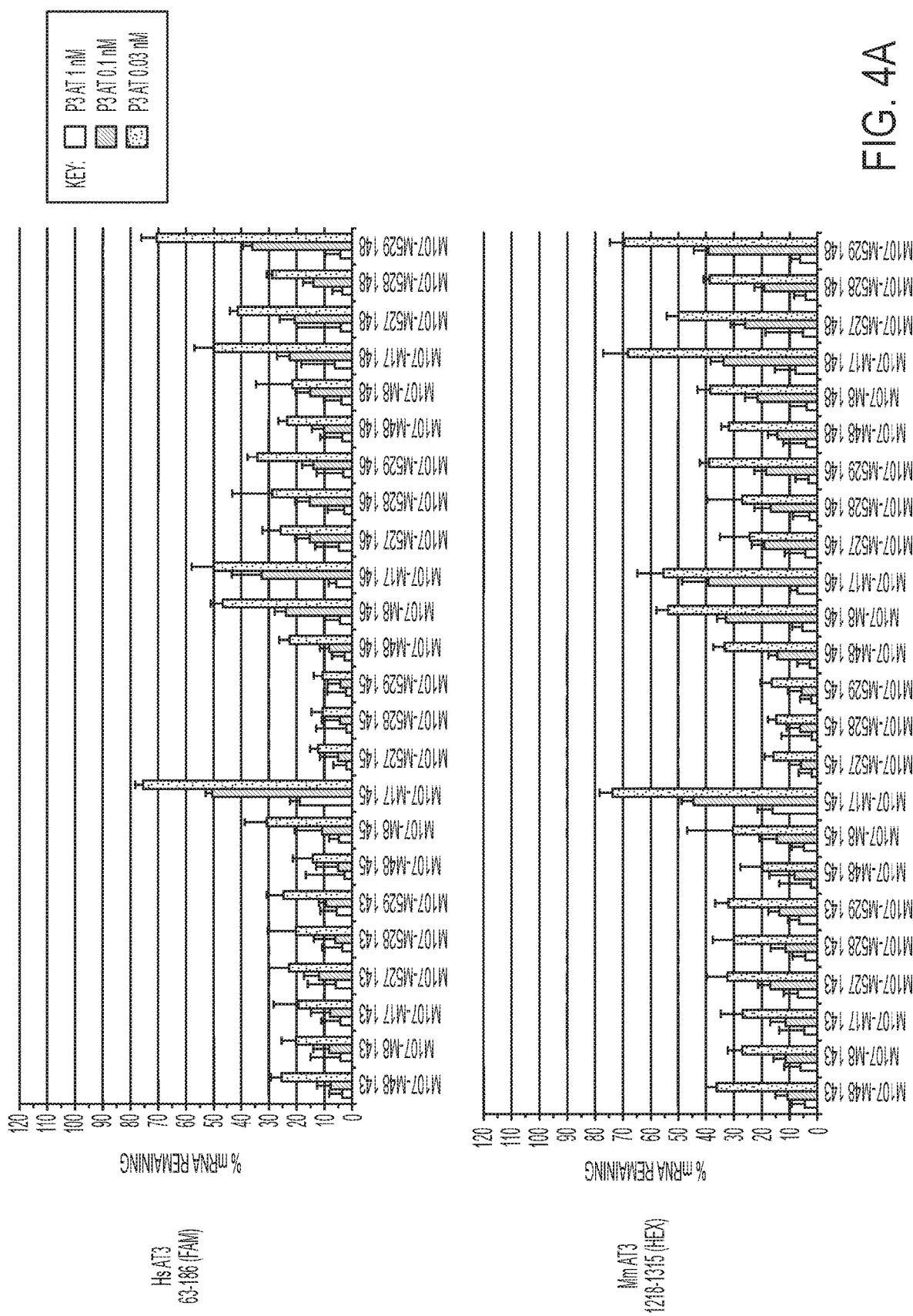
FIGS. 4A to 4E show histograms of human and mouse AT3 inhibitory efficacies observed for a selection of 16 human DsiRNAs prepared with a series of 2'-O-methyl guide strand modification patterns "M17", "M527", "M528", "M529", "M48" and "M8" (FIGS. 4A to 4D) and for a selection of 12 mouse DsiRNAs prepared with a series of (FIG. 4E) 2'-O-methyl guide strand modification patterns "M48", "M527", "M528" and "M529", each paired with "M107" passenger strand modifications.
Figure 4B:
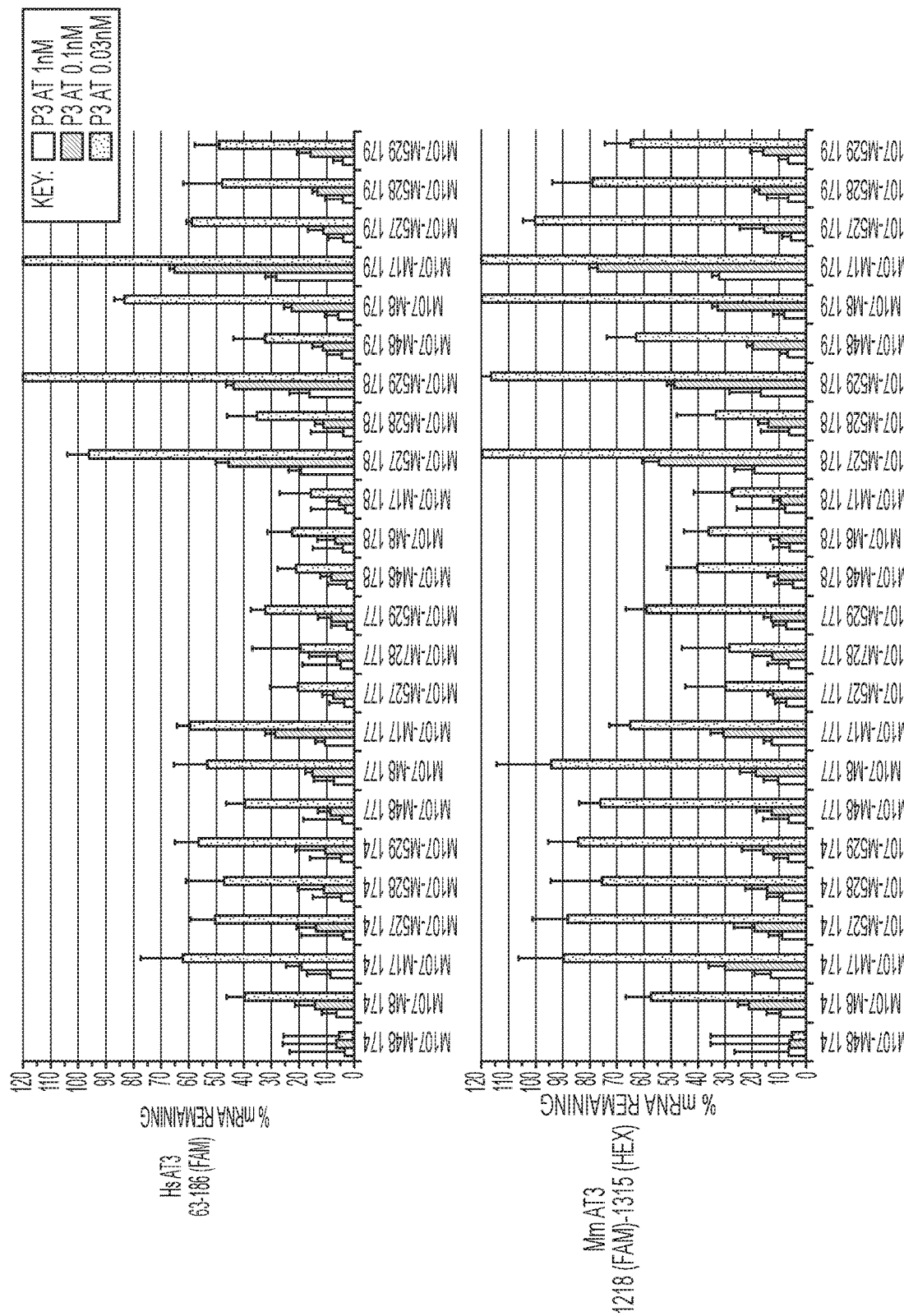
Figure 4C:
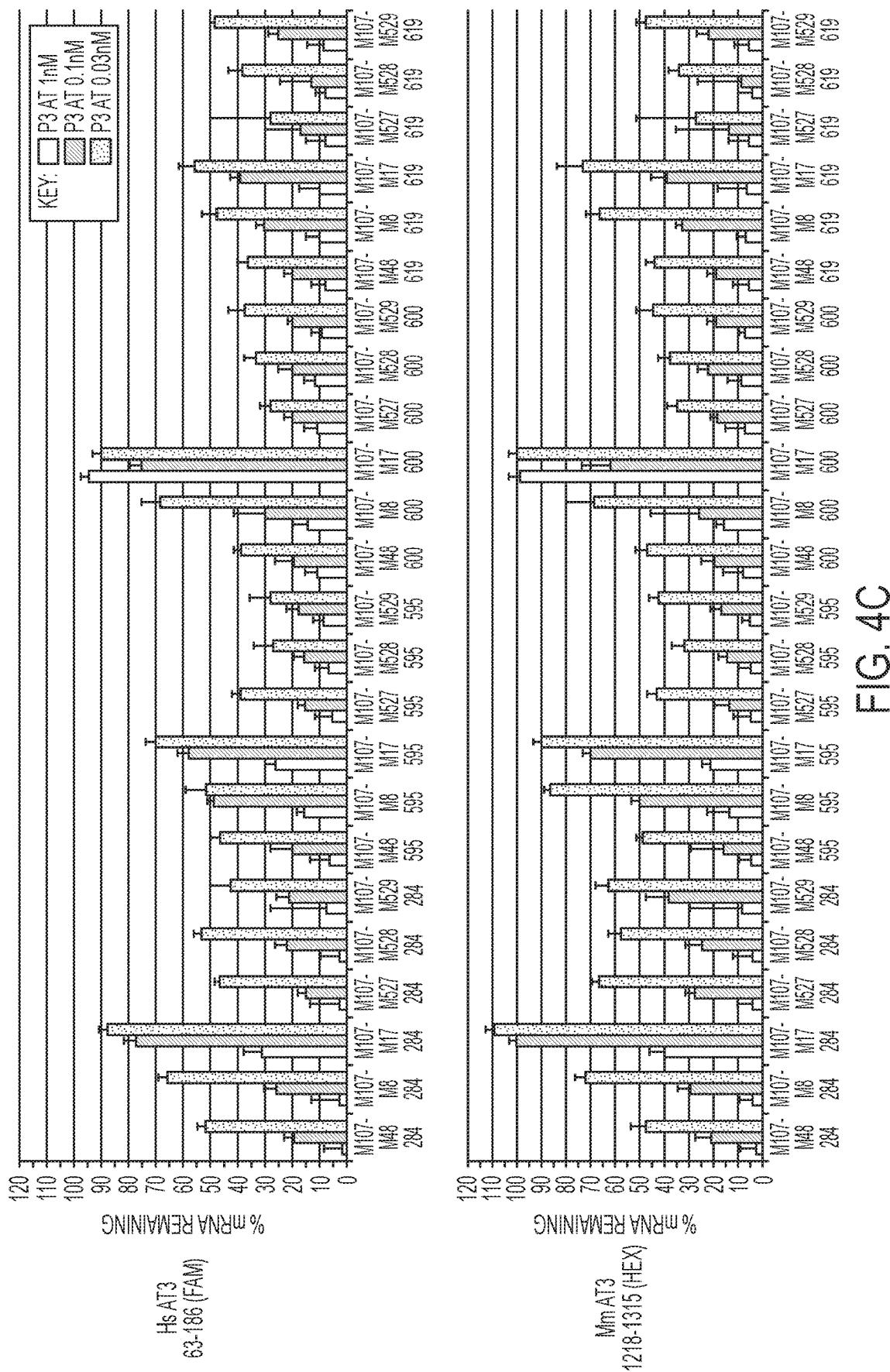
Figure 4D:
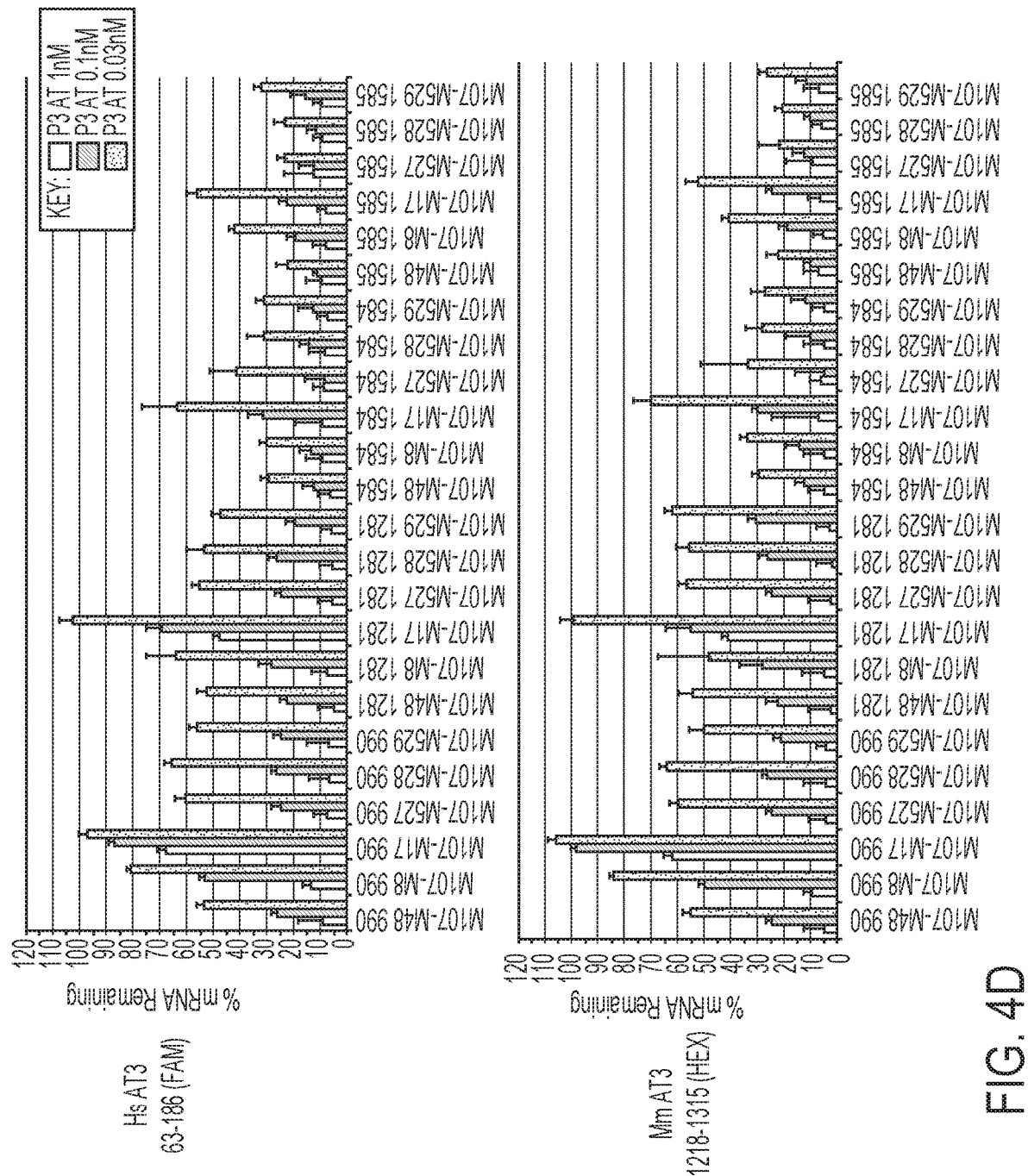
Figure 4E:
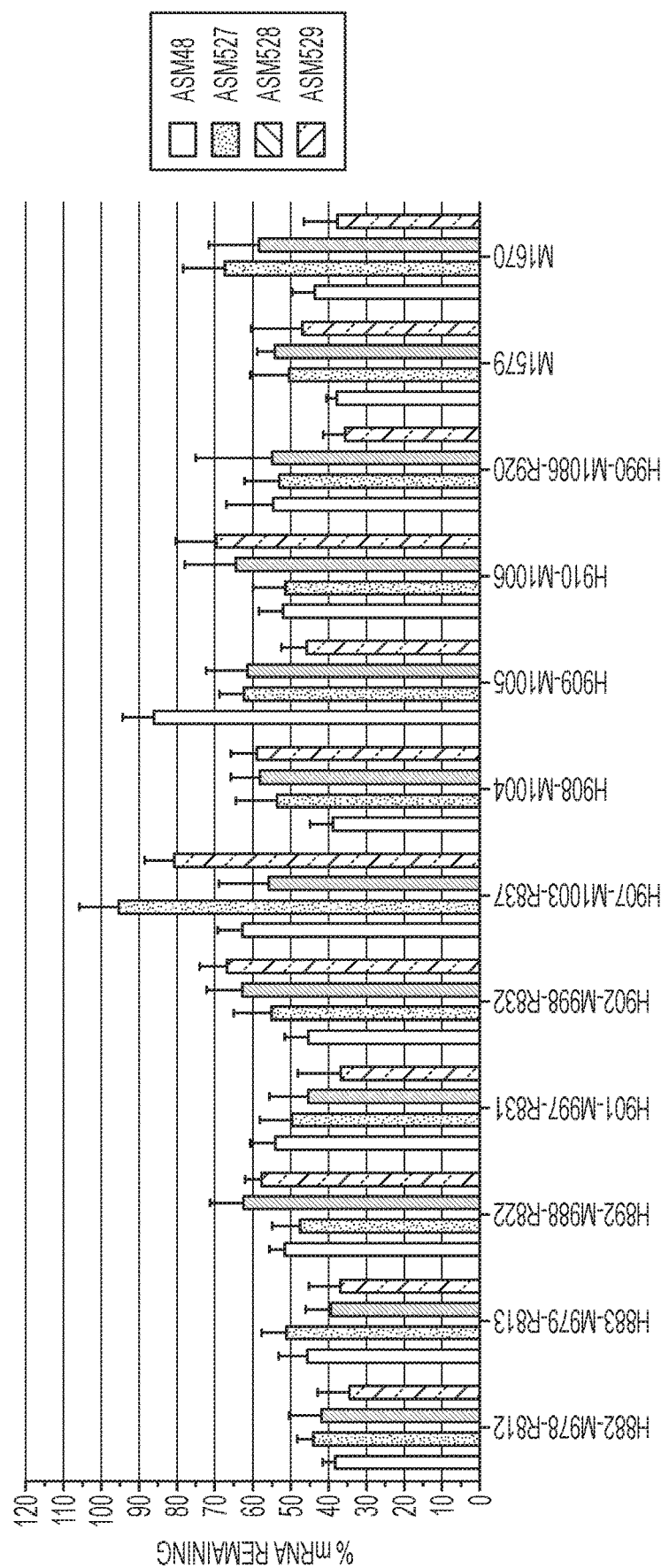

The present invention is directed to compositions that contain nucleic acids, for example double stranded RNA ("dsRNA"), and methods for preparing them, that are capable of reducing the level and/or expression of the Antithrombin 3 (AT3) gene in vivo or in vitro. One of the strands of the dsRNA contains a region of nucleotide sequence that has a length that ranges from 19 to 35 or more nucleotides that can direct the destruction and/or translational inhibition of the targeted AT3 transcript.

Definitions

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991). As used herein, the following terms have the meanings ascribed to them below, unless specified otherwise.

The present invention features one or more DsiRNA molecules that can modulate (e.g., inhibit) AT3 expression. The DsiRNAs of the invention optionally can be used in combination with modulators of other genes and/or gene products associated with the maintenance or development of diseases or disorders associated with AT3 misregulation (e.g., hemophilia, atypical hemolytic uremic syndrome (aHUS) or other disease or disorder associated with AT3 misregulation). The DsiRNA agents of the invention modulate AT3 RNAs such as those corresponding to the cDNA sequences referred to by GenBank Accession Nos. NM_000488.3 (human SERPINC1; also named human AT3) and NM_080844.4 (mouse Serpinc1, the mouse homologue of human SERPINC1/AT3), which are referred to herein generally as "Antithrombin 3."

The below description of the various aspects and embodiments of the invention is provided with reference to exemplary AT3 RNAs. However, such reference is meant to be exemplary only and the various aspects and embodiments of the invention are also directed to alternate AT3 RNAs, such as mutant AT3 RNAs or additional AT3 splice variants.

The term "Antithrombin 3" refers to nucleic acid sequences encoding an Antithrombin 3 protein, peptide, or polypeptide (e.g., AT3 transcripts, such as the sequences of AT3 Genbank Accession Nos. NM_000488.3 and NM_080844.4). In certain embodiments, the term "Antithrombin 3" is also meant to include other AT3 encoding sequence, such as other AT3 isoforms, mutant AT3 genes, splice variants of AT3 genes, and AT3 gene polymorphisms. The term "Antithrombin 3" is also used to refer to the polypeptide gene product of an AT3 gene/transript, e.g., an AT3 protein, peptide, or polypeptide, such as those encoded by AT3 Genbank Accession Nos. NP_000479.1 and NP_543120.1.

As used herein, an "Antithrombin 3-associated disease or disorder" refers to a disease or disorder known in the art to be associated with altered AT3 expression, level and/or activity. Notably, an "Antithrombin 3-associated disease or disorder" or "AT3-associated disease or disorder" includes diseases or disorders of the blood, bone marrow and other organs including, but not limited to, hemophilia.

In certain embodiments, dsRNA-mediated inhibition of an AT3 target sequence is assessed. In such embodiments, AT3 RNA levels can be assessed by art-recognized methods (e.g., RT-PCR, Northern blot, expression array, etc.), optionally via comparison of AT3 levels in the presence of an anti-AT3 dsRNA of the invention relative to the absence of such an anti-AT3 dsRNA. In certain embodiments, AT3 levels in the presence of an anti-AT3 dsRNA are compared to those observed in the presence of vehicle alone, in the presence of a dsRNA directed against an unrelated target RNA, or in the absence of any treatment.

It is also recognized that levels of AT3 protein can be assessed and that AT3 protein levels are, under different conditions, either directly or indirectly related to AT3 RNA levels and/or the extent to which a dsRNA inhibits AT3 expression, thus art-recognized methods of assessing AT3 protein levels (e.g., Western blot, immunoprecipitation, other antibody-based methods, etc.) can also be employed to examine the inhibitory effect of a dsRNA of the invention.

An anti-AT3 dsRNA of the invention is deemed to possess "AT3 inhibitory activity" if a statistically significant reduction in AT3 RNA (or when the AT3 protein is assessed, AT3 protein levels) is seen when an anti-AT3 dsRNA of the invention is administered to a system (e.g., cell-free in vitro system), cell, tissue or organism, as compared to a selected control. The distribution of experimental values and the number of replicate assays performed will tend to dictate the parameters of what levels of reduction in AT3 RNA (either as a % or in absolute terms) is deemed statistically significant (as assessed by standard methods of determining statistical significance known in the art). However, in certain embodiments, "AT3 inhibitory activity" is defined based upon a % or absolute level of reduction in the level of AT3 in a system, cell, tissue or organism. For example, in certain embodiments, a dsRNA of the invention is deemed to possess AT3 inhibitory activity if at least a 5% reduction or at least a 10% reduction in AT3 RNA is observed in the presence of a dsRNA of the invention relative to AT3 levels seen for a suitable control. (For example, in vivo AT3 levels in a tissue and/or subject can, in certain embodiments, be deemed to be inhibited by a dsRNA agent of the invention if, e.g., a 5% or 10% reduction in AT3 levels is observed relative to a control.) In certain other embodiments, a dsRNA of the invention is deemed to possess AT3 inhibitory activity if AT3 RNA levels are observed to be reduced by at least 15% relative to a selected control, by at least 20% relative to a selected control, by at least 25% relative to a selected control, by at least 30% relative to a selected control, by at least 35% relative to a selected control, by at least 40% relative to a selected control, by at least 45% relative to a selected control, by at least 50% relative to a selected control, by at least 55% relative to a selected control, by at least 60% relative to a selected control, by at least 65% relative to a selected control, by at least 70% relative to a selected control, by at least 75% relative to a selected control, by at least 80% relative to a selected control, by at least 85% relative to a selected control, by at least 90% relative to a selected control, by at least 95% relative to a selected control, by at least 96% relative to a selected control, by at least 97% relative to a selected control, by at least 98% relative to a selected control or by at least 99% relative to a selected control. In some embodiments, complete inhibition of AT3 is required for a dsRNA to be deemed to possess AT3 inhibitory activity. In certain models (e.g., cell culture), a dsRNA is deemed to possess AT3 inhibitory activity if at least a 50% reduction in AT3 levels is observed relative to a suitable control. In certain other embodiments, a dsRNA is deemed to possess AT3 inhibitory activity if at least an 80% reduction in AT3 levels is observed relative to a suitable control.

By way of specific example, in Example 2 below, a series of DsiRNAs targeting AT3 were tested for the ability to reduce AT3 mRNA levels in human HepG2 or mouse H36.12J cells in vitro, at 1 nM concentrations in the environment of such cells and in the presence of a transfection agent (Lipofectamine™ RNAiMAX, Invitrogen). Within Example 2 below, AT3 inhibitory activity was ascribed to those DsiRNAs that were observed to effect at least a 50% reduction of AT3 mRNA levels under the assayed conditions. It is contemplated that AT3 inhibitory activity could also be attributed to a dsRNA under either more or less stringent conditions than those employed for Example 2 below, even when the same or a similar assay and conditions are employed. For example, in certain embodiments, a tested dsRNA of the invention is deemed to possess AT3 inhibitory activity if at least a 10% reduction, at least a 20% reduction, at least a 30% reduction, at least a 40% reduction, at least a 50% reduction, at least a 60% reduction, at least a 70% reduction, at least a 75% reduction, at least an 80% reduction, at least an 85% reduction, at least a 90% reduction, or at least a 95% reduction in AT3 mRNA levels is observed in a mammalian cell line in vitro at 1 nM dsRNA concentration or lower in the environment of a cell, relative to a suitable control.

Use of other endpoints for determination of whether a double stranded RNA of the invention possesses AT3 inhibitory activity is also contemplated. Specifically, in one embodiment, in addition to or as an alternative to assessing AT3 mRNA levels, the ability of a tested dsRNA to reduce AT3 protein levels (e.g., at 48 hours after contacting a mammalian cell in vitro or in vivo) is assessed, and a tested dsRNA is deemed to possess AT3 inhibitory activity if at least a 10% reduction, at least a 20% reduction, at least a 30% reduction, at least a 40% reduction, at least a 50% reduction, at least a 60% reduction, at least a 70% reduction, at least a 75% reduction, at least an 80% reduction, at least an 85% reduction, at least a 90% reduction, or at least a 95% reduction in AT3 protein levels is observed in a mammalian cell contacted with the assayed double stranded RNA in vitro or in vivo, relative to a suitable control. Additional endpoints contemplated include, e.g., assessment of a phenotype associated with reduction of AT3 levels—e.g., preventing or reducing hemophelia and/or signs of hemophilia in a subject (e.g., bleeding into joints, etc.) and/or reducing the need for blood transfusions and/or improving quality of life throughout the body.

AT3 inhibitory activity can also be evaluated over time (duration) and over concentration ranges (potency), with assessment of what constitutes a dsRNA possessing AT3 inhibitory activity adjusted in accordance with concentrations administered and duration of time following administration. Thus, in certain embodiments, a dsRNA of the invention is deemed to possess AT3 inhibitory activity if at least a 50% reduction in AT3 activity is observed/persists at a duration of time of 2 hours, 5 hours, 10 hours, 1 day, 2 days, 3 days, 4 days, 5 days, 6 days, 7 days, 8 days, 9 days, 10 days or more after administration of the dsRNA to a cell or organism. In additional embodiments, a dsRNA of the invention is deemed to be a potent AT3 inhibitory agent if AT3 inhibitory activity (e.g., in certain embodiments, at least 50% inhibition of AT3) is observed at a concentration of 1 nM or less, 500 pM or less, 200 pM or less, 100 pM or less, 50 pM or less, 20 pM or less, 10 pM or less, 5 pM or less, 2 pM or less or even 1 pM or less in the environment of a cell, for example, within an in vitro assay for AT3 inhibitory activity as described herein. In certain embodiments, a potent AT3 inhibitory dsRNA of the invention is defined as one that is capable of AT3 inhibitory activity (e.g., in certain embodiments, at least 20% reduction of AT3 levels) at a formulated concentration of 10 mg/kg or less when administered to a subject in an effective delivery vehicle (e.g., an effective lipid nanoparticle formulation). Optionally, a potent AT3 inhibitory dsRNA of the invention is defined as one that is capable of AT3 inhibitory activity (e.g., in certain embodiments, at least 50% reduction of AT3 levels) at a formulated concentration of 5 mg/kg or less when administered to a subject in an effective delivery vehicle. In additional embodiments, a potent AT3 inhibitory dsRNA of the invention is defined as one that is capable of AT3 inhibitory activity (e.g., in certain embodiments, at least 50% reduction of AT3 levels) at a formulated concentration of 5 mg/kg or less when administered to a subject in an effective delivery vehicle. Optionally, a potent AT3 inhibitory dsRNA of the invention is defined as one that is capable of AT3 inhibitory activity (e.g., in certain embodiments, at least 50% reduction of AT3 levels) at a formulated concentration of 2 mg/kg or less, or even 1 mg/kg or less, when administered to a subject in an effective delivery vehicle.

In certain embodiments, potency of a dsRNA of the invention is determined in reference to the number of copies of a dsRNA present in the cytoplasm of a target cell that are required to achieve a certain level of target gene knockdown. For example, in certain embodiments, a potent dsRNA is one capable of causing 50% or greater knockdown of a target mRNA when present in the cytoplasm of a target cell at a copy number of 1000 or fewer RISC-loaded antisense strands per cell. More preferably, a potent dsRNA is one capable of producing 50% or greater knockdown of a target mRNA when present in the cytoplasm of a target cell at a copy number of 500 or fewer RISC-loaded antisense strands per cell. Optionally, a potent dsRNA is one capable of producing 50% or greater knockdown of a target mRNA when present in the cytoplasm of a target cell at a copy number of 300 or fewer RISC-loaded antisense strands per cell.

In further embodiments, the potency of a DsiRNA of the invention can be defined in reference to a 19 to 23mer dsRNA directed to the same target sequence within the same target gene. For example, a DsiRNA of the invention that possesses enhanced potency relative to a corresponding 19 to 23mer dsRNA can be a DsiRNA that reduces a target gene by an additional 5% or more, an additional 10% or more, an additional 20% or more, an additional 30% or more, an additional 40% or more, or an additional 50% or more as compared to a corresponding 19 to 23mer dsRNA, when assayed in an in vitro assay as described herein at a sufficiently low concentration to allow for detection of a potency difference (e.g., transfection concentrations at or below 1 nM in the environment of a cell, at or below 100 pM in the environment of a cell, at or below 10 pM in the environment of a cell, at or below 1 nM in the environment of a cell, in an in vitro assay as described herein; notably, it is recognized that potency differences can be best detected via performance of such assays across a range of concentrations—e.g., 0.1 pM to 10 nM—for purpose of generating a dose-response curve and identifying an $IC_{50}$ value associated with a DsiRNA/dsRNA).

AT3 inhibitory levels and/or AT3 levels may also be assessed indirectly, e.g., measurement of a reduction of hemophilia phenotype(s) in a subject may be used to assess AT3 levels and/or AT3 inhibitory efficacy of a double-stranded nucleic acid of the instant invention.

In certain embodiments, the phrase "consists essentially of" is used in reference to the anti-AT3 dsRNAs of the invention. In some such embodiments, "consists essentially of" refers to a composition that comprises a dsRNA of the invention which possesses at least a certain level of AT3 inhibitory activity (e.g., at least 50% AT3 inhibitory activity) and that also comprises one or more additional components and/or modifications that do not significantly impact the AT3 inhibitory activity of the dsRNA. For example, in certain embodiments, a composition "consists essentially of" a dsRNA of the invention where modifications of the dsRNA of the invention and/or dsRNA-associated components of the composition do not alter the AT3 inhibitory activity (optionally including potency or duration of AT3 inhibitory activity) by greater than 3%, greater than 5%, greater than 10%, greater than 15%, greater than 20%, greater than 25%, greater than 30%, greater than 35%, greater than 40%, greater than 45%, or greater than 50% relative to the dsRNA of the invention in isolation. In certain embodiments, a composition is deemed to consist essentially of a dsRNA of the invention even if more dramatic reduction of AT3 inhibitory activity (e.g., 80% reduction, 90% reduction, etc. in efficacy, duration and/or potency) occurs in the presence of additional components or modifications, yet where AT3 inhibitory activity is not significantly elevated (e.g., observed levels of AT3 inhibitory activity are within 10% those observed for the isolated dsRNA of the invention) in the presence of additional components and/or modifications.

As used herein, the term "nucleic acid" refers to deoxyribonucleotides, ribonucleotides, or modified nucleotides, and polymers thereof in single- or double-stranded form. The term encompasses nucleic acids containing known nucleotide analogs or modified backbone residues or linkages, which are synthetic, naturally occurring, and non-naturally occurring, which have similar binding properties as the reference nucleic acid, and which are metabolized in a manner similar to the reference nucleotides. Examples of such analogs include, without limitation, phosphorothioates, phosphoramidates, methyl phosphonates, chiral-methyl phosphonates, 2-O-methyl ribonucleotides, peptide-nucleic acids (PNAs) and unlocked nucleic acids (UNAs; see, e.g., Jensen et al. *Nucleic Acids Symposium Series* 52: 133-4), and derivatives thereof.

As used herein, "nucleotide" is used as recognized in the art to include those with natural bases (standard), and modified bases well known in the art. Such bases are generally located at the 1' position of a nucleotide sugar moiety. Nucleotides generally comprise a base, sugar and a phosphate group. The nucleotides can be unmodified or modified at the sugar, phosphate and/or base moiety, (also referred to interchangeably as nucleotide analogs, modified nucleotides, non-natural nucleotides, non-standard nucleotides and other; see, e.g., Usman and McSwiggen, supra; Eckstein, et al., International PCT Publication No. WO 92/07065; Usman et al, International PCT Publication No. WO 93/15187; Uhlman & Peyman, supra, all are hereby incorporated by reference herein). There are several examples of modified nucleic acid bases known in the art as summarized by Limbach, et al, *Nucleic Acids Res.* 22:2183, 1994. Some of the non-limiting examples of base modifications that can be introduced into nucleic acid molecules include, hypoxanthine, purine, pyridin-4-one, pyridin-2-one, phenyl, pseudouracil, 2,4,6-trimethoxy benzene, 3-methyl uracil, dihydrouridine, naphthyl, aminophenyl, 5-alkylcytidines (e.g., 5-methylcytidine), 5-alkyluridines (e.g., ribothymidine), 5-halouridine (e.g., 5-bromouridine) or 6-azapyrimidines or 6-alkylpyrimidines (e.g. 6-methyluridine), propyne, and others (Burgin, et al., Biochemistry 35:14090, 1996; Uhlman & Peyman, supra). By "modified bases" in this aspect is meant nucleotide bases other than adenine, guanine, cytosine and uracil at 1' position or their equivalents.

As used herein, "modified nucleotide" refers to a nucleotide that has one or more modifications to the nucleoside, the nucleobase, pentose ring, or phosphate group. For example, modified nucleotides exclude ribonucleotides containing adenosine monophosphate, guanosine monophosphate, uridine monophosphate, and cytidine monophosphate and deoxyribonucleotides containing deoxyadenosine monophosphate, deoxyguanosine monophosphate, deoxythymidine monophosphate, and deoxycytidine monophosphate. Modifications include those naturally occurring that result from modification by enzymes that modify nucleotides, such as methyltransferases. Modified nucleotides also include synthetic or non-naturally occurring nucleotides. Synthetic or non-naturally occurring modifications in nucleotides include those with 2' modifications, e.g., 2'-methoxyethoxy, 2'-fluoro, 2'-allyl, 2'-O-[2-(methylamino)-2-oxoethyl], 4'-thio, 4'-CH$_2$—O-2'-bridge, 4'-(CH$_2$)$_2$—O-2'-bridge, 2'-LNA or other bicyclic or "bridged" nucleoside analog, and 2'-O—(N-methylcarbamate) or those comprising base analogs. In connection with 2'-modified nucleotides as described for the present disclosure, by "amino" is meant 2'-NH$_2$ or 2'-O—NH$_2$, which can be modified or unmodified. Such modified groups are described, e.g., in Eckstein et al., U.S. Pat. No. 5,672,695 and Matulic-Adamic et al., U.S. Pat. No. 6,248,878. "Modified nucleotides" of the instant invention can also include nucleotide analogs as described above.

In reference to the nucleic acid molecules of the present disclosure, modifications may exist upon these agents in patterns on one or both strands of the double stranded ribonucleic acid (dsRNA). As used herein, "alternating positions" refers to a pattern where every other nucleotide is a modified nucleotide or there is an unmodified nucleotide (e.g., an unmodified ribonucleotide) between every modified nucleotide over a defined length of a strand of the dsRNA (e.g., 5'-MNMNMN-3'; 3'-MNMNMN-5'; where M is a modified nucleotide and N is an unmodified nucleotide). The modification pattern starts from the first nucleotide position at either the 5' or 3' terminus according to a position numbering convention, e.g., as described herein (in certain embodiments, position 1 is designated in reference to the terminal residue of a strand following a projected Dicer cleavage event of a DsiRNA agent of the invention; thus, position 1 does not always constitute a 3' terminal or 5' terminal residue of a pre-processed agent of the invention). The pattern of modified nucleotides at alternating positions may run the full length of the strand, but in certain embodiments includes at least 4, 6, 8, 10, 12, 14 nucleotides containing at least 2, 3, 4, 5, 6 or 7 modified nucleotides, respectively. As used herein, "alternating pairs of positions" refers to a pattern where two consecutive modified nucleotides are separated by two consecutive unmodified nucleotides over a defined length of a strand of the dsRNA (e.g., 5'-MMNNMMNNMMNN-3'; 3'-MMNNMMNNMMNN-5'; where M is a modified nucleotide and N is an unmodified nucleotide). The modification pattern starts from the first nucleotide position at either the 5' or 3' terminus according to a position numbering convention such as those described herein. The pattern of modified nucleotides at alternating positions may run the full length of the strand, but preferably includes at least 8, 12, 16, 20, 24, 28 nucleotides containing at least 4, 6, 8, 10, 12 or 14 modified nucleotides, respectively. It is emphasized that the above modification patterns are exemplary and are not intended as limitations on the scope of the invention.

As used herein, "base analog" refers to a heterocyclic moiety which is located at the 1' position of a nucleotide sugar moiety in a modified nucleotide that can be incorporated into a nucleic acid duplex (or the equivalent position in a nucleotide sugar moiety substitution that can be incorporated into a nucleic acid duplex). In the dsRNAs of the invention, a base analog is generally either a purine or pyrimidine base excluding the common bases guanine (G), cytosine (C), adenine (A), thymine (T), and uracil (U). Base analogs can duplex with other bases or base analogs in dsRNAs. Base analogs include those useful in the compounds and methods of the invention, e.g., those disclosed in U.S. Pat. Nos. 5,432,272 and 6,001,983 to Benner and US Patent Publication No. 20080213891 to Manoharan, which are herein incorporated by reference. Non-limiting examples of bases include hypoxanthine (I), xanthine (X), 3β-D-ribofuranosyl-(2,6-diaminopyrimidine) (K), 3-β-D-ribofuranosyl-(1-methyl-pyrazolo[4,3-d]pyrimidine-5,7(4H,6H)-dione) (P), iso-cytosine (iso-C), iso-guanine (iso-G), 1-β-D-ribofuranosyl-(5-nitroindole), 1-β-D-ribofuranosyl-(3-nitropyrrole), 5-bromouracil, 2-aminopurine, 4-thio-dT, 7-(2-thienyl)-imidazo[4,5-b]pyridine (Ds) and pyrrole-2-carbaldehyde (Pa), 2-amino-6-(2-thienyl)purine (S), 2-oxopyridine (Y), difluorotolyl, 4-fluoro-6-methylbenzimidazole, 4-methylbenzimidazole, 3-methyl isocarbostyrilyl, 5-methyl isocarbostyrilyl, and 3-methyl-7-propynyl isocarbostyrilyl, 7-azaindolyl, 6-methyl-7-azaindolyl, imidizopyridinyl, 9-methyl-imidizopyridinyl, pyrrolopyrizinyl, isocarbostyrilyl, 7-propynyl isocarbostyrilyl, propynyl-7-azaindolyl, 2,4,5-trimethylphenyl, 4-methylindolyl, 4,6-dimethylindolyl, phenyl, napthalenyl, anthracenyl, phenanthracenyl, pyrenyl, stilbenzyl, tetracenyl, pentacenyl, and structural derivates thereof (Schweitzer et al., J. Org. Chem., 59:7238-7242 (1994); Berger et al., Nucleic Acids Research, 28(15):2911-2914 (2000); Moran et al., J. Am. Chem. Soc., 119:2056-2057 (1997); Morales et al., J. Am. Chem. Soc., 121:2323-2324 (1999); Guckian et al., J. Am. Chem. Soc., 118:8182-8183 (1996); Morales et al., J. Am. Chem. Soc., 122(6):1001-1007 (2000); McMinn et al., J. Am. Chem. Soc., 121:11585-11586 (1999); Guckian et al., J. Org. Chem., 63:9652-9656 (1998); Moran et al., Proc. Natl. Acad. Sci., 94:10506-10511 (1997); Das et al., J. Chem. Soc., Perkin Trans., 1:197-206 (2002); Shibata et al., J. Chem. Soc., Perkin Trans., 1: 1605-1611 (2001); Wu et al., J. Am. Chem. Soc., 122(32):7621-7632 (2000); O'Neill et al., J. Org. Chem., 67:5869-5875 (2002); Chaudhuri et al., J. Am. Chem. Soc., 117:10434-10442 (1995); and U.S. Pat. No. 6,218,108.). Base analogs may also be a universal base.

As used herein, "universal base" refers to a heterocyclic moiety located at the 1' position of a nucleotide sugar moiety in a modified nucleotide, or the equivalent position in a nucleotide sugar moiety substitution, that, when present in a nucleic acid duplex, can be positioned opposite more than one type of base without altering the double helical structure (e.g., the structure of the phosphate backbone). Additionally, the universal base does not destroy the ability of the single stranded nucleic acid in which it resides to duplex to a target nucleic acid. The ability of a single stranded nucleic acid containing a universal base to duplex a target nucleic can be assayed by methods apparent to one in the art (e.g., UV absorbance, circular dichroism, gel shift, single stranded nuclease sensitivity, etc.). Additionally, conditions under which duplex formation is observed may be varied to determine duplex stability or formation, e.g., temperature, as melting temperature (Tm) correlates with the stability of nucleic acid duplexes. Compared to a reference single stranded nucleic acid that is exactly complementary to a target nucleic acid, the single stranded nucleic acid containing a universal base forms a duplex with the target nucleic acid that has a lower Tm than a duplex formed with the complementary nucleic acid. However, compared to a reference single stranded nucleic acid in which the universal base has been replaced with a base to generate a single mismatch, the single stranded nucleic acid containing the universal base forms a duplex with the target nucleic acid that has a higher Tm than a duplex formed with the nucleic acid having the mismatched base.

Some universal bases are capable of base pairing by forming hydrogen bonds between the universal base and all of the bases guanine (G), cytosine (C), adenine (A), thymine (T), and uracil (U) under base pair forming conditions. A universal base is not a base that forms a base pair with only one single complementary base. In a duplex, a universal base may form no hydrogen bonds, one hydrogen bond, or more than one hydrogen bond with each of G, C, A, T, and U opposite to it on the opposite strand of a duplex. Preferably, the universal bases does not interact with the base opposite to it on the opposite strand of a duplex. In a duplex, base pairing between a universal base occurs without altering the double helical structure of the phosphate backbone. A universal base may also interact with bases in adjacent nucleotides on the same nucleic acid strand by stacking interactions. Such stacking interactions stabilize the duplex, especially in situations where the universal base does not form any hydrogen bonds with the base positioned opposite to it on the opposite strand of the duplex. Non-limiting examples of universal-binding nucleotides include inosine, 1-β-D-ribofuranosyl-5-nitroindole, and/or 1-β-D-ribofuranosyl-3-nitropyrrole (US Pat. Appl. Publ. No. 20070254362 to Quay et al.; Van Aerschot et al., An acyclic 5-nitroindazole nucleoside analogue as ambiguous nucleoside. Nucleic Acids Res. 1995 Nov. 11; 23(21):4363-70; Loakes et al., 3-Nitropyrrole and 5-nitroindole as universal bases in primers for DNA sequencing and PCR. Nucleic Acids Res. 1995 Jul. 11; 23(13):2361-6; Loakes and Brown, 5-Nitroindole as an universal base analogue. Nucleic Acids Res. 1994 Oct. 11; 22(20):4039-43).

As used herein, "loop" refers to a structure formed by a single strand of a nucleic acid, in which complementary regions that flank a particular single stranded nucleotide region hybridize in a way that the single stranded nucleotide region between the complementary regions is excluded from duplex formation or Watson-Crick base pairing. A loop is a single stranded nucleotide region of any length. Examples of loops include the unpaired nucleotides present in such structures as hairpins, stem loops, or extended loops.

As used herein, "extended loop" in the context of a dsRNA refers to a single stranded loop and in addition 1, 2, 3, 4, 5, 6 or up to 20 base pairs or duplexes flanking the loop. In an extended loop, nucleotides that flank the loop on the 5' side form a duplex with nucleotides that flank the loop on the 3' side. An extended loop may form a hairpin or stem loop.

As used herein, "tetraloop" in the context of a dsRNA refers to a loop (a single stranded region) consisting of four nucleotides that forms a stable secondary structure that contributes to the stability of adjacent Watson-Crick hybridized nucleotides. Without being limited to theory, a tetraloop may stabilize an adjacent Watson-Crick base pair by stacking interactions. In addition, interactions among the four nucleotides in a tetraloop include but are not limited to non-Watson-Crick base pairing, stacking interactions, hydrogen bonding, and contact interactions (Cheong et al., Nature 1990 Aug. 16; 346(6285):680-2; Heus and Pardi, Science 1991 Jul. 12; 253(5016):191-4). A tetraloop confers an increase in the melting temperature (Tm) of an adjacent duplex that is higher than expected from a simple model loop sequence consisting of four random bases. For example, a tetraloop can confer a melting temperature of at least 55° C. in 10 mM NaHPO$_4$ to a hairpin comprising a duplex of at least 2 base pairs in length. A tetraloop may contain ribonucleotides, deoxyribonucleotides, modified nucleotides, and combinations thereof. Examples of RNA tetraloops include the UNCG family of tetraloops (e.g., UUCG), the GNRA family of tetraloops (e.g., GAAA), and the CUUG tetraloop. (Woese et al., Proc Natl Acad Sci USA. 1990 November; 87(21):8467-71; Antao et al., Nucleic Acids Res. 1991 Nov. 11; 19(21):5901-5). Examples of DNA tetraloops include the d(GNNA) family of tetraloops (e.g., d(GTTA), the d(GNRA)) family of tetraloops, the d(GNAB) family of tetraloops, the d(CNNG) family of tetraloops, the d(TNCG) family of tetraloops (e.g., d(TTCG)). (Nakano et al. Biochemistry, 41 (48), 14281-14292, 2002; SHINJI et al. Nippon Kagakkai Koen Yokoshu VOL. 78th; NO. 2; PAGE. 731 (2000).)

As used herein, the term "siRNA" refers to a double stranded nucleic acid in which each strand comprises RNA, RNA analog(s) or RNA and DNA. The siRNA comprises between 19 and 23 nucleotides or comprises 21 nucleotides. The siRNA typically has 2 bp overhangs on the 3' ends of each strand such that the duplex region in the siRNA comprises 17-21 nucleotides, or 19 nucleotides. Typically, the antisense strand of the siRNA is sufficiently complementary with the target sequence of the AT3 (SERPINC1) gene/RNA.

In certain embodiments, an anti-AT3 DsiRNA of the instant invention possesses strand lengths of at least 25 nucleotides. Accordingly, in certain embodiments, an anti-AT3 DsiRNA contains one oligonucleotide sequence, a first sequence, that is at least 25 nucleotides in length and no longer than 35 or up to 50 or more (e.g., up to 80 or more) nucleotides. In certain embodiments, this sequence of RNA can be between 26 and 35, 26 and 34, 26 and 33, 26 and 32, 26 and 31, 26 and 30, and 26 and 29 nucleotides in length. This sequence can be 27 or 28 nucleotides in length or 27 nucleotides in length. The second sequence of the DsiRNA agent can be a sequence that anneals to the first sequence under biological conditions, such as within the cytoplasm of a eukaryotic cell. Generally, the second oligonucleotide sequence will have at least 19 complementary base pairs with the first oligonucleotide sequence, more typically the second oligonucleotide sequence will have 21 or more complementary base pairs, or 25 or more complementary base pairs with the first oligonucleotide sequence. In one embodiment, the second sequence is the same length as the first sequence, and the DsiRNA agent is blunt ended. In another embodiment, the ends of the DsiRNA agent have one or more overhangs.

In certain embodiments, the first and second oligonucleotide sequences of the DsiRNA agent exist on separate oligonucleotide strands that can be and typically are chemically synthesized. In some embodiments, both strands are between 26 and 35 nucleotides in length. In other embodiments, both strands are between 25 and 30 or 26 and 30 nucleotides in length. In one embodiment, both strands are 27 nucleotides in length, are completely complementary and have blunt ends. In certain embodiments of the instant invention, the first and second sequences of an anti-AT3 DsiRNA exist on separate RNA oligonucleotides (strands). In one embodiment, one or both oligonucleotide strands are capable of serving as a substrate for Dicer. In other embodiments, at least one modification is present that promotes Dicer to bind to the double-stranded RNA structure in an orientation that maximizes the double-stranded RNA structure's effectiveness in inhibiting gene expression. In certain embodiments of the instant invention, the anti-AT3 DsiRNA agent is comprised of two oligonucleotide strands of differing lengths, with the anti-AT3 DsiRNA possessing a blunt end at the 3' terminus of a first strand (sense strand) and a 3' overhang at the 3' terminus of a second strand (antisense strand). The DsiRNA can also contain one or more deoxyribonucleic acid (DNA) base substitutions.

Suitable DsiRNA compositions that contain two separate oligonucleotides can be chemically linked outside their annealing region by chemical linking groups. Many suitable chemical linking groups are known in the art and can be used. Suitable groups will not block Dicer activity on the DsiRNA and will not interfere with the directed destruction of the RNA transcribed from the target gene. Alternatively, the two separate oligonucleotides can be linked by a third oligonucleotide such that a hairpin structure is produced upon annealing of the two oligonucleotides making up the DsiRNA composition. The hairpin structure will not block Dicer activity on the DsiRNA and will not interfere with the directed destruction of the target RNA.

The dsRNA molecule can be designed such that every residue of the antisense strand is complementary to a residue in the target molecule. Alternatively, substitutions can be made within the molecule to increase stability and/or enhance processing activity of said molecule. Substitutions can be made within the strand or can be made to residues at the ends of the strand. In certain embodiments, substitutions and/or modifications are made at specific residues within a DsiRNA agent. Such substitutions and/or modifications can include, e.g., deoxy-modifications at one or more residues of positions 1, 2 and 3 when numbering from the 3' terminal position of the sense strand of a DsiRNA agent; and introduction of 2'-O-alkyl (e.g., 2'-O-methyl) modifications at the 3' terminal residue of the antisense strand of DsiRNA agents, with such modifications also being performed at overhang positions of the 3' portion of the antisense strand and at alternating residues of the antisense strand of the DsiRNA that are included within the region of a DsiRNA agent that is processed to form an active siRNA agent. The preceding modifications are offered as exemplary, and are not intended to be limiting in any manner. Further consideration of the structure of preferred DsiRNA agents, including further description of the modifications and substitutions that can be performed upon the anti-AT3 DsiRNA agents of the instant invention, can be found below.

Where a first sequence is referred to as "substantially complementary" with respect to a second sequence herein, the two sequences can be fully complementary, or they may form one or more, but generally not more than 4, 3 or 2 mismatched base pairs upon hybridization, while retaining the ability to hybridize under the conditions most relevant to their ultimate application. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, may yet be referred to as "fully complementary" for the purposes of the invention.

The term "double-stranded RNA" or "dsRNA", as used herein, refers to a complex of ribonucleic acid molecules, having a duplex structure comprising two anti-parallel and substantially complementary, as defined above, nucleic acid strands. The two strands forming the duplex structure may be different portions of one larger RNA molecule, or they may be separate RNA molecules. Where separate RNA molecules, such dsRNA are often referred to as siRNA ("short interfering RNA") or DsiRNA ("Dicer substrate siRNAs"). Where the two strands are part of one larger molecule, and therefore are connected by an uninterrupted chain of nucleotides between the 3'-end of one strand and the 5' end of the respective other strand forming the duplex structure, the connecting RNA chain is referred to as a "hairpin loop", "short hairpin RNA" or "shRNA". Where the two strands are connected covalently by means other than an uninterrupted chain of nucleotides between the 3'-end of one strand and the 5'end of the respective other strand forming the duplex structure, the connecting structure is referred to as a "linker". The RNA strands may have the same or a different number of nucleotides. The maximum number of base pairs is the number of nucleotides in the shortest strand of the dsRNA minus any overhangs that are present in the duplex. In addition to the duplex structure, a dsRNA may comprise one or more nucleotide overhangs. In addition, as used herein, "dsRNA" may include chemical modifications to ribonucleotides, internucleoside linkages, end-groups, caps, and conjugated moieties, including substantial modifications at multiple nucleotides and including all types of modifications disclosed herein or known in the art. Any such modifications, as used in an siRNA- or DsiRNA-type molecule, are encompassed by "dsRNA" for the purposes of this specification and claims.

The phrase "duplex region" refers to the region in two complementary or substantially complementary oligonucleotides that form base pairs with one another, either by Watson-Crick base pairing or other manner that allows for a duplex between oligonucleotide strands that are complementary or substantially complementary. For example, an oligonucleotide strand having 21 nucleotide units can base pair with another oligonucleotide of 21 nucleotide units, yet only 19 bases on each strand are complementary or substantially complementary, such that the "duplex region" consists of 19 base pairs. The remaining base pairs may, for example, exist as 5' and 3' overhangs. Further, within the duplex region, 100% complementarity is not required; substantial complementarity is allowable within a duplex region. Substantial complementarity refers to complementarity between the strands such that they are capable of annealing under biological conditions. Techniques to empirically determine if two strands are capable of annealing under biological conditions are well know in the art. Alternatively, two strands can be synthesized and added together under biological conditions to determine if they anneal to one another.

Single-stranded nucleic acids that base pair over a number of bases are said to "hybridize." Hybridization is typically determined under physiological or biologically relevant conditions (e.g., intracellular: pH 7.2, 140 mM potassium ion; extracellular pH 7.4, 145 mM sodium ion). Hybridization conditions generally contain a monovalent cation and biologically acceptable buffer and may or may not contain a divalent cation, complex anions, e.g. gluconate from potassium gluconate, uncharged species such as sucrose, and inert polymers to reduce the activity of water in the sample, e.g. PEG. Such conditions include conditions under which base pairs can form.

Hybridization is measured by the temperature required to dissociate single stranded nucleic acids forming a duplex, i.e., (the melting temperature; Tm). Hybridization conditions are also conditions under which base pairs can form. Various conditions of stringency can be used to determine hybridization (see, e.g., Wahl, G. M. and S. L. Berger (1987) Methods Enzymol. 152:399; Kimmel, A. R. (1987) Methods Enzymol. 152:507). Stringent temperature conditions will ordinarily include temperatures of at least about 30° C., more preferably of at least about 37° C., and most preferably of at least about 42° C. The hybridization temperature for hybrids anticipated to be less than 50 base pairs in length should be 5-10° C. less than the melting temperature (Tm) of the hybrid, where Tm is determined according to the following equations. For hybrids less than 18 base pairs in length, Tm(° C.)=2(# of A+T bases)+4(# of G+C bases). For hybrids between 18 and 49 base pairs in length, Tm(° C.)=81.5+16.6(log 10[Na+])+0.41 (% G+C)−(600/N), where N is the number of bases in the hybrid, and [Na+] is the concentration of sodium ions in the hybridization buffer ([Na+] for 1×SSC=0.165 M). For example, a hybridization determination buffer is shown in Table 1.

TABLE 1

|  | final conc. | Vender | Cat# | Lot# | m.w./Stock | To make 50 mL solution |
|---|---|---|---|---|---|---|
| NaCl | 100 mM | Sigma | S-5150 | 41K8934 | 5M | 1 mL |
| KCl | 80 mM | Sigma | P-9541 | 70K0002 | 74.55 | 0.298 g |
| MgCl$_2$ | 8 mM | Sigma | M-1028 | 120K8933 | 1M | 0.4 mL |
| sucrose | 2% w/v | Fisher | BP220-212 | 907105 | 342.3 | 1 g |
| Tris-HCl | 16 mM | Fisher | BP1757-500 | 12419 | 1M | 0.8 mL |
| NaH$_2$PO$_4$ | 1 mM | Sigma | S-3193 | 52H-029515 | 120.0 | 0.006 g |
| EDTA | 0.02 mM | Sigma | E-7889 | 110K89271 | 0.5M | 2 μL |
| H$_2$O pH = 7.0 at 20° C. |  | Sigma | W-4502 | 51K2359 adjust with HCl |  | to 50 mL |

Useful variations on hybridization conditions will be readily apparent to those skilled in the art. Hybridization techniques are well known to those skilled in the art and are described, for example, in Benton and Davis (Science 196: 180, 1977); Grunstein and Hogness (Proc. Natl. Acad. Sci., USA 72:3961, 1975); Ausubel et al. (Current Protocols in Molecular Biology, Wiley Interscience, New York, 2001); Berger and Kimmel (Antisense to Molecular Cloning Techniques, 1987, Academic Press, New York); and Sambrook et al., Molecular Cloning: A Laboratory Manual, Cold Spring Harbor Laboratory Press, New York.

As used herein, "oligonucleotide strand" is a single stranded nucleic acid molecule. An oligonucleotide may comprise ribonucleotides, deoxyribonucleotides, modified nucleotides (e.g., nucleotides with 2' modifications, synthetic base analogs, etc.) or combinations thereof. Such modified oligonucleotides can be preferred over native forms because of properties such as, for example, enhanced cellular uptake and increased stability in the presence of nucleases.

As used herein, the term "ribonucleotide" encompasses natural and synthetic, unmodified and modified ribonucleotides. Modifications include changes to the sugar moiety, to the base moiety and/or to the linkages between ribonucleotides in the oligonucleotide. As used herein, the term "ribonucleotide" specifically excludes a deoxyribonucleotide, which is a nucleotide possessing a single proton group at the 2' ribose ring position.

As used herein, the term "deoxyribonucleotide" encompasses natural and synthetic, unmodified and modified deoxyribonucleotides. Modifications include changes to the sugar moiety, to the base moiety and/or to the linkages between deoxyribonucleotide in the oligonucleotide. As used herein, the term "deoxyribonucleotide" also includes a modified ribonucleotide that does not permit Dicer cleavage of a dsRNA agent, e.g., a 2'-O-methyl ribonucleotide, a phosphorothioate-modified ribonucleotide residue, etc., that does not permit Dicer cleavage to occur at a bond of such a residue.

As used herein, the term "PS-NA" refers to a phosphorothioate-modified nucleotide residue. The term "PS-NA" therefore encompasses both phosphorothioate-modified ribonucleotides ("PS-RNAs") and phosphorothioate-modified deoxyribonucleotides ("PS-DNAs").

As used herein, "Dicer" refers to an endoribonuclease in the RNase III family that cleaves a dsRNA or dsRNA-containing molecule, e.g., double-stranded RNA (dsRNA) or pre-microRNA (miRNA), into double-stranded nucleic acid fragments 19-25 nucleotides long, usually with a two-base overhang on the 3' end. With respect to certain dsRNAs of the invention (e.g., "DsiRNAs"), the duplex formed by a dsRNA region of an agent of the invention is recognized by Dicer and is a Dicer substrate on at least one strand of the duplex. Dicer catalyzes the first step in the RNA interference pathway, which consequently results in the degradation of a target RNA. The protein sequence of human Dicer is provided at the NCBI database under accession number NP_085124, hereby incorporated by reference.

Dicer "cleavage" can be determined as follows (e.g., see Collingwood et al., Oligonucleotides 18:187-200 (2008)). In a Dicer cleavage assay, RNA duplexes (100 pmol) are incubated in 20 μL of 20 mM Tris pH 8.0, 200 mM NaCl, 2.5 mM MgCl2 with or without 1 unit of recombinant human Dicer (Stratagene, La Jolla, Calif.) at 37° C. for 18-24 hours. Samples are desalted using a Performa SR 96-well plate (Edge Biosystems, Gaithersburg, Md.). Electrospray-ionization liquid chromatography mass spectroscopy (ESI-LCMS) of duplex RNAs pre- and post-treatment with Dicer is done using an Oligo HTCS system (Novatia, Princeton, N.J.; Hail et al., 2004), which consists of a ThermoFinnigan TSQ7000, Xcalibur data system, ProMass data processing software and Paradigm MS4 HPLC (Michrom BioResources, Auburn, Calif.). In this assay, Dicer cleavage occurs where at least 5%, 10%, 20%, 30%, 40%, 50%, 60%, 70%, 80%, 90%, 95%, or even 100% of the Dicer substrate dsRNA, (i.e., 25-30 bp, dsRNA, preferably 26-30 bp dsRNA) is cleaved to a shorter dsRNA (e.g., 19-23 bp dsRNA, preferably, 21-23 bp dsRNA).

As used herein, "Dicer cleavage site" refers to the sites at which Dicer cleaves a dsRNA (e.g., the dsRNA region of a DsiRNA agent of the invention). Dicer contains two RNase III domains which typically cleave both the sense and antisense strands of a dsRNA. The average distance between the RNase III domains and the PAZ domain determines the length of the short double-stranded nucleic acid fragments it produces and this distance can vary (Macrae et al. (2006) Science 311: 195-8). As shown in FIG. 1, Dicer is projected to cleave certain double-stranded ribonucleic acids of the instant invention that possess an antisense strand having a 2 nucleotide 3' overhang at a site between the $21^{st}$ and $22^{nd}$ nucleotides removed from the 3' terminus of the antisense strand, and at a corresponding site between the $21^{st}$ and $22^{nd}$ nucleotides removed from the 5' terminus of the sense strand. The projected and/or prevalent Dicer cleavage site(s) for dsRNA molecules distinct from those depicted in FIG. 1 may be similarly identified via art-recognized methods, including those described in Macrae et al. While the Dicer cleavage events depicted in FIG. 1 generate 21 nucleotide siRNAs, it is noted that Dicer cleavage of a dsRNA (e.g., DsiRNA) can result in generation of Dicer-processed siRNA lengths of 19 to 23 nucleotides in length. Indeed, in certain embodiments, a double-stranded DNA region may be included within a dsRNA for purpose of directing prevalent Dicer excision of a typically non-preferred 19mer or 20mer siRNA, rather than a 21mer.

As used herein, "overhang" refers to unpaired nucleotides, in the context of a duplex having one or more free ends at the 5' terminus or 3' terminus of a dsRNA. In certain embodiments, the overhang is a 3' or 5' overhang on the antisense strand or sense strand. In some embodiments, the overhang is a 3' overhang having a length of between one and six nucleotides, optionally one to five, one to four, one to three, one to two, two to six, two to five, two to four, two to three, three to six, three to five, three to four, four to six, four to five, five to six nucleotides, or one, two, three, four, five or six nucleotides. "Blunt" or "blunt end" means that there are no unpaired nucleotides at that end of the dsRNA, i.e., no nucleotide overhang. For clarity, chemical caps or non-nucleotide chemical moieties conjugated to the 3' end or 5' end of an siRNA are not considered in determining whether an siRNA has an overhang or is blunt ended. In certain embodiments, the invention provides a dsRNA molecule for inhibiting the expression of the AT3 target gene in a cell or mammal, wherein the dsRNA comprises an antisense strand comprising a region of complementarity which is complementary to at least a part of an mRNA formed in the expression of the AT3 target gene, and wherein the region of complementarity is less than 35 nucleotides in length, optionally 19-24 nucleotides in length or 25-30 nucleotides in length, and wherein the dsRNA, upon contact with a cell expressing the AT3 target gene, inhibits the expression of the AT3 target gene by at least 10%, 25%, or 40%.

A dsRNA of the invention comprises two RNA strands that are sufficiently complementary to hybridize to form a duplex structure. One strand of the dsRNA (the antisense strand) comprises a region of complementarity that is substantially complementary, and generally fully complementary, to a target sequence, derived from the sequence of an mRNA formed during the expression of the AT3 target gene, the other strand (the sense strand) comprises a region which is complementary to the antisense strand, such that the two strands hybridize and form a duplex structure when combined under suitable conditions. Generally, the duplex structure is between 15 and 80, or between 15 and 53, or between 15 and 35, optionally between 25 and 30, between 26 and 30, between 18 and 25, between 19 and 24, or between 19 and 21 base pairs in length. Similarly, the region of complementarity to the target sequence is between 15 and 35, optionally between 18 and 30, between 25 and 30, between 19 and 24, or between 19 and 21 nucleotides in length. The dsRNA of the invention may further comprise one or more single-stranded nucleotide overhang(s). It has been identified that dsRNAs comprising duplex structures of between 15 and 35 base pairs in length can be effective in inducing RNA interference, including DsiRNAs (generally of at least 25 base pairs in length) and siRNAs (in certain embodiments, duplex structures of siRNAs are between 20 and 23, and optionally, specifically 21 base pairs (Elbashir et al., *EMBO* 20: 6877-6888)). It has also been identified that dsRNAs possessing duplexes shorter than 20 base pairs can be effective as well (e.g., 15, 16, 17, 18 or 19 base pair duplexes). In certain embodiments, the dsRNAs of the invention can comprise at least one strand of a length of 19 nucleotides or more. In certain embodiments, it can be reasonably expected that shorter dsRNAs comprising a sequence complementary to one of the sequences of Tables 4 or 6, minus only a few nucleotides on one or both ends may be similarly effective as compared to the dsRNAs described above and in Tables 2, 3 and 5. Hence, dsRNAs comprising a partial sequence of at least 15, 16, 17, 18, 19, 20, or more contiguous nucleotides sufficiently complementary to one of the sequences of Tables 4 or 6, and differing in their ability to inhibit the expression of the AT3 target gene in an assay as described herein by not more than 5, 10, 15, 20, 25, or 30% inhibition from a dsRNA comprising the full sequence, are contemplated by the invention. In one embodiment, at least one end of the dsRNA has a single-stranded nucleotide overhang of 1 to 5, optionally 1 to 4, in certain embodiments, 1 or 2 nucleotides. Certain dsRNA structures having at least one nucleotide overhang possess superior inhibitory properties as compared to counterparts possessing base-paired blunt ends at both ends of the dsRNA molecule.

As used herein, the term "RNA processing" refers to processing activities performed by components of the siRNA, miRNA or RNase H pathways (e.g., Drosha, Dicer, Argonaute2 or other RISC endoribonucleases, and RNaseH), which are described in greater detail below (see "RNA Processing" section below). The term is explicitly distinguished from the post-transcriptional processes of 5' capping of RNA and degradation of RNA via non-RISC- or non-RNase H-mediated processes. Such "degradation" of an RNA can take several forms, e.g. deadenylation (removal of a 3' poly(A) tail), and/or nuclease digestion of part or all of the body of the RNA by one or more of several endo- or exo-nucleases (e.g., RNase III, RNase P, RNase Ti, RNase A (1, 2, 3, 4/5), oligonucleotidase, etc.).

By "homologous sequence" is meant a nucleotide sequence that is shared by one or more polynucleotide sequences, such as genes, gene transcripts and/or non-coding polynucleotides. For example, a homologous sequence can be a nucleotide sequence that is shared by two or more genes encoding related but different proteins, such as different members of a gene family, different protein epitopes, different protein isoforms or completely divergent genes, such as a cytokine and its corresponding receptors. A homologous sequence can be a nucleotide sequence that is shared by two or more non-coding polynucleotides, such as noncoding DNA or RNA, regulatory sequences, introns, and sites of transcriptional control or regulation. Homologous sequences can also include conserved sequence regions shared by more than one polynucleotide sequence. Homology does not need to be perfect homology (e.g., 100%), as partially homologous sequences are also contemplated by the instant invention (e.g., 99%, 98%, 97%, 96%, 95%, 94%, 93%, 92%, 91%, 90%, 89%, 88%, 87%, 86%, 85%, 84%, 83%, 82%, 81%, 80% etc.). Indeed, design and use of the dsRNA agents of the instant invention contemplates the possibility of using such dsRNA agents not only against target RNAs of AT3 possessing perfect complementarity with the presently described dsRNA agents, but also against target AT3 RNAs possessing sequences that are, e.g., only 99%, 98%, 97%, 96%, 95%, 94%, 93%, 92%, 91%, 90%, 89%, 88%, 87%, 86%, 85%, 84%, 83%, 82%, 81%, 80% etc. complementary to said dsRNA agents. Similarly, it is contemplated that the presently described dsRNA agents of the instant invention might be readily altered by the skilled artisan to enhance the extent of complementarity between said dsRNA agents and a target AT3 RNA, e.g., of a specific allelic variant of AT3 (e.g., an allele of enhanced therapeutic interest). Indeed, dsRNA agent sequences with insertions, deletions, and single point mutations relative to the target AT3 sequence can also be effective for inhibition. Alternatively, dsRNA agent sequences with nucleotide analog substitutions or insertions can be effective for inhibition.

Sequence identity may be determined by sequence comparison and alignment algorithms known in the art. To determine the percent identity of two nucleic acid sequences (or of two amino acid sequences), the sequences are aligned for comparison purposes (e.g., gaps can be introduced in the first sequence or second sequence for optimal alignment). The nucleotides (or amino acid residues) at corresponding nucleotide (or amino acid) positions are then compared. When a position in the first sequence is occupied by the same residue as the corresponding position in the second sequence, then the molecules are identical at that position. The percent identity between the two sequences is a function of the number of identical positions shared by the sequences (i.e., % homology=# of identical positions/total # of positions×100), optionally penalizing the score for the number of gaps introduced and/or length of gaps introduced.

The comparison of sequences and determination of percent identity between two sequences can be accomplished using a mathematical algorithm. In one embodiment, the alignment generated over a certain portion of the sequence aligned having sufficient identity but not over portions having low degree of identity (i.e., a local alignment). A preferred, non-limiting example of a local alignment algorithm utilized for the comparison of sequences is the algorithm of Karlin and Altschul (1990) *Proc. Natl. Acad. Sci. USA* 87:2264-68, modified as in Karlin and Altschul (1993) *Proc. Natl. Acad. Sci. USA* 90:5873-77. Such an algorithm is incorporated into the BLAST programs (version 2.0) of Altschul, et al. (1990) *J. Mol. Biol.* 215:403-10.

In another embodiment, a gapped alignment, the alignment is optimized by introducing appropriate gaps, and percent identity is determined over the length of the aligned sequences (i.e., a gapped alignment). To obtain gapped alignments for comparison purposes, Gapped BLAST can be utilized as described in Altschul et al., (1997) Nucleic Acids Res. 25(17):3389-3402. In another embodiment, a global alignment the alignment is optimized by introducing appropriate gaps, and percent identity is determined over the entire length of the sequences aligned. (i.e., a global alignment). A preferred, non-limiting example of a mathematical algorithm utilized for the global comparison of sequences is the algorithm of Myers and Miller, CABIOS (1989). Such an algorithm is incorporated into the ALIGN program (version 2.0) which is part of the GCG sequence alignment software package. When utilizing the ALIGN program for comparing amino acid sequences, a PAM120 weight residue table, a gap length penalty of 12, and a gap penalty of 4 can be used.

Greater than 80% sequence identity, e.g., 80%, 81%, 82%, 83%, 84%, 85%, 86%, 87%, 88%, 89%, 90%, 91%, 92%, 93%, 94%, 95%, 96%, 97%, 98%, 99% or even 100% sequence identity, between the dsRNA antisense strand and the portion of the AT3 RNA sequence is preferred. Alternatively, the dsRNA may be defined functionally as a nucleotide sequence (or oligonucleotide sequence) that is capable of hybridizing with a portion of the AT3 RNA (e.g., 400 mM NaCl, 40 mM PIPES pH 6.4, 1 mM EDTA, 50° C. or 70° C. hybridization for 12-16 hours; followed by washing). Additional preferred hybridization conditions include hybridization at 70° C. in 1×SSC or 50° C. in 1×SSC, 50% formamide followed by washing at 70° C. in 0.3×SSC or hybridization at 70° C. in 4×SSC or 50° C. in 4×SSC, 50% formamide followed by washing at 67° C. in 1×SSC. The hybridization temperature for hybrids anticipated to be less than 50 base pairs in length should be 5-10° C. less than the melting temperature (Tm) of the hybrid, where Tm is determined according to the following equations. For hybrids less than 18 base pairs in length, Tm(° C.)=2(# of A+T bases)+4(# of G+C bases). For hybrids between 18 and 49 base pairs in length, Tm(° C.)=81.5+16.6(log 10[Na+])+0.41 (% G+C)-(600/N), where N is the number of bases in the hybrid, and [Na+] is the concentration of sodium ions in the hybridization buffer ([Na+] for 1×SSC=0.165 M). Additional examples of stringency conditions for polynucleotide hybridization are provided in Sambrook, J., E. F. Fritsch, and T. Maniatis, 1989, Molecular Cloning: A Laboratory Manual, Cold Spring Harbor Laboratory Press, Cold Spring Harbor, N.Y., chapters 9 and 11, and Current Protocols in Molecular Biology, 1995, F. M. Ausubel et al., eds., John Wiley & Sons, Inc., sections 2.10 and 6.3-6.4. The length of the identical nucleotide sequences may be at least 10, 12, 15, 17, 20, 22, 25, 27 or 30 bases.

By "conserved sequence region" is meant, a nucleotide sequence of one or more regions in a polynucleotide does not vary significantly between generations or from one biological system, subject, or organism to another biological system, subject, or organism. The polynucleotide can include both coding and non-coding DNA and RNA.

By "sense region" is meant a nucleotide sequence of a dsRNA molecule having complementarity to an antisense region of the dsRNA molecule. In addition, the sense region of a dsRNA molecule can comprise a nucleic acid sequence having homology with a target nucleic acid sequence.

By "antisense region" is meant a nucleotide sequence of a dsRNA molecule having complementarity to a target nucleic acid sequence. In addition, the antisense region of a dsRNA molecule comprises a nucleic acid sequence having complementarity to a sense region of the dsRNA molecule.

As used herein, "antisense strand" refers to a single stranded nucleic acid molecule which has a sequence complementary to that of a target RNA. When the antisense strand contains modified nucleotides with base analogs, it is not necessarily complementary over its entire length, but must at least hybridize with a target RNA.

As used herein, "sense strand" refers to a single stranded nucleic acid molecule which has a sequence complementary to that of an antisense strand. When the antisense strand contains modified nucleotides with base analogs, the sense strand need not be complementary over the entire length of the antisense strand, but must at least duplex with the antisense strand.

As used herein, "guide strand" refers to a single stranded nucleic acid molecule of a dsRNA or dsRNA-containing molecule, which has a sequence sufficiently complementary to that of a target RNA to result in RNA interference. After cleavage of the dsRNA or dsRNA-containing molecule by Dicer, a fragment of the guide strand remains associated with RISC, binds a target RNA as a component of the RISC complex, and promotes cleavage of a target RNA by RISC. As used herein, the guide strand does not necessarily refer to a continuous single stranded nucleic acid and may comprise a discontinuity, preferably at a site that is cleaved by Dicer. A guide strand is an antisense strand.

As used herein, "passenger strand" refers to an oligonucleotide strand of a dsRNA or dsRNA-containing molecule, which has a sequence that is complementary to that of the guide strand. As used herein, the passenger strand does not necessarily refer to a continuous single stranded nucleic acid and may comprise a discontinuity, preferably at a site that is cleaved by Dicer. A passenger strand is a sense strand.

By "target nucleic acid" is meant a nucleic acid sequence whose expression, level or activity is to be modulated. The target nucleic acid can be DNA or RNA. For agents that target AT3, in certain embodiments, the target nucleic acid is AT3 RNA, e.g., in certain embodiments, AT3 mRNA. AT3 RNA target sites can also interchangeably be referenced by corresponding cDNA sequences. Levels of AT3 may also be targeted via targeting of upstream effectors of AT3, or the effects of modulated or misregulated AT3 may also be modulated by targeting of molecules downstream of AT3 in the AT3 signalling pathway.

By "complementarity" is meant that a nucleic acid can form hydrogen bond(s) with another nucleic acid sequence by either traditional Watson-Crick or other non-traditional types. In reference to the nucleic molecules of the present invention, the binding free energy for a nucleic acid molecule with its complementary sequence is sufficient to allow the relevant function of the nucleic acid to proceed, e.g., RNAi activity. Determination of binding free energies for nucleic acid molecules is well known in the art (see, e.g., Turner et al., 1987, CSH Symp. Quant. Biol. LII pp. 123-133; Frier et al., 1986, Proc. Nat. Acad. Sci. USA 83:9373-9377; Turner et al., 1987, J. Am. Chem. Soc. 109:3783-3785). A percent complementarity indicates the percentage of contiguous residues in a nucleic acid molecule that can form hydrogen bonds (e.g., Watson-Crick base pairing) with a second nucleic acid sequence (e.g., 5, 6, 7, 8, 9, or 10 nucleotides out of a total of 10 nucleotides in the first oligonucleotide being based paired to a second nucleic acid sequence having 10 nucleotides represents 50%, 60%, 70%, 80%, 90%, and 100% complementary respectively). "Perfectly complementary" means that all the contiguous residues of a nucleic acid sequence will hydrogen bond with the same number of contiguous residues in a second nucleic acid sequence. In one embodiment, a dsRNA molecule of the invention comprises 19 to 30 (e.g., 19, 20, 21, 22, 23, 24, 25, 26, 27, 28, 29, or 30 or more) nucleotides that are complementary to one or more target nucleic acid molecules or a portion thereof.

As used herein, a dsNA, e.g., DsiRNA or siRNA, having a sequence "sufficiently complementary" to a target RNA or cDNA sequence (e.g., AT3 mRNA) means that the dsNA has a sequence sufficient to trigger the destruction of the target RNA (where a cDNA sequence is recited, the RNA sequence corresponding to the recited cDNA sequence) by the RNAi machinery (e.g., the RISC complex) or process. For example, a dsNA that is "sufficiently complementary" to a target RNA or cDNA sequence to trigger the destruction of the target RNA by the RNAi machinery or process can be identified as a dsNA that causes a detectable reduction in the level of the target RNA in an appropriate assay of dsNA activity (e.g., an in vitro assay as described in Example 2 below), or, in further examples, a dsNA that is sufficiently complementary to a target RNA or cDNA sequence to trigger the destruction of the target RNA by the RNAi machinery or process can be identified as a dsNA that produces at least a 5%, at least a 10%, at least a 15%, at least a 20%, at least a 25%, at least a 30%, at least a 35%, at least a 40%, at least a 45%, at least a 50%, at least a 55%, at least a 60%, at least a 65%, at least a 70%, at least a 75%, at least a 80%, at least a 85%, at least a 90%, at least a 95%, at least a 98% or at least a 99% reduction in the level of the target RNA in an appropriate assay of dsNA activity. In additional examples, a dsNA that is sufficiently complementary to a target RNA or cDNA sequence to trigger the destruction of the target RNA by the RNAi machinery or process can be identified based upon assessment of the duration of a certain level of inhibitory activity with respect to the target RNA or protein levels in a cell or organism. For example, a dsNA that is sufficiently complementary to a target RNA or cDNA sequence to trigger the destruction of the target RNA by the RNAi machinery or process can be identified as a dsNA capable of reducing target mRNA levels by at least 20% at least 48 hours post-administration of said dsNA to a cell or organism. Preferably, a dsNA that is sufficiently complementary to a target RNA or cDNA sequence to trigger the destruction of the target RNA by the RNAi machinery or process is identified as a dsNA capable of reducing target mRNA levels by at least 40% at least 72 hours post-administration of said dsNA to a cell or organism, by at least 40% at least four, five or seven days post-administration of said dsNA to a cell or organism, by at least 50% at least 48 hours post-administration of said dsNA to a cell or organism, by at least 50% at least 72 hours post-administration of said dsNA to a cell or organism, by at least 50% at least four, five or seven days post-administration of said dsNA to a cell or organism, by at least 80% at least 48 hours post-administration of said dsNA to a cell or organism, by at least 80% at least 72 hours post-administration of said dsNA to a cell or organism, or by at least 80% at least four, five or seven days post-administration of said dsNA to a cell or organism.

In certain embodiments, a nucleic acid of the invention (e.g., a DsiRNA or siRNA) possesses a sequence "sufficiently complementary to hybridize" to a target RNA or cDNA sequence, thereby achieving an inhibitory effect upon the target RNA. Hybridization, and conditions available for determining whether one nucleic acid is sufficiently complementary to another nucleic acid to allow the two sequences to hybridize, is described in greater detail below.

As will be clear to one of ordinary skill in the art, "sufficiently complementary" (contrasted with, e.g., "100% complementary") allows for one or more mismatches to exist between a dsNA of the invention and the target RNA or cDNA sequence (e.g., AT3 mRNA), provided that the dsNA possesses complementarity sufficient to trigger the destruction of the target RNA by the RNAi machinery (e.g., the RISC complex) or process. In certain embodiments, a "sufficiently complementary" dsNA of the invention can harbor one, two, three or even four or more mismatches between the dsNA sequence and the target RNA or cDNA sequence (e.g., in certain such embodiments, the antisense strand of the dsRNA harbors one, two, three, four, five or even six or more mismatches when aligned with the target RNA or cDNA sequence for maximum complementarity). Additional consideration of the preferred location of such mismatches within certain dsRNAs of the instant invention is considered in greater detail below.

In one embodiment, dsRNA molecules of the invention that down regulate or reduce AT3 gene expression are used for treating, preventing or reducing AT3-related diseases or disorders (e.g., hemophilia) in a subject or organism.

In one embodiment of the present invention, each sequence of a DsiRNA molecule of the invention is independently 25 to 35 nucleotides in length, in specific embodiments 25, 26, 27, 28, 29, 30, 31, 32, 33, 34 or 35 nucleotides in length. In another embodiment, the DsiRNA duplexes of the invention independently comprise 25 to 30 base pairs (e.g., 25, 26, 27, 28, 29, or 30). In another embodiment, one or more strands of the DsiRNA molecule of the invention independently comprises 19 to 35 nucleotides (e.g., 19, 20, 21, 22, 23, 24, 25, 26, 27, 28, 29, 30, 31, 32, 33, 34 or 35) that are complementary to a target (AT3) nucleic acid molecule. In certain embodiments, a DsiRNA molecule of the invention possesses a length of duplexed nucleotides between 25 and 66 nucleotides, optionally between 25 and 49 nucleotides in length (e.g., 25, 26, 27, 28, 29, 30, 31, 32, 33, 34, 35, 36, 37, 38, 39, 40, 41, 42, 43, 44, 45, 46, 47, 48 or 49, 50, 51, 52, 53, 54, 55, 56, 57, 58, 59, 60, 61, 62, 63, 64, 65, 66 nucleotides in length; optionally, all such nucleotides base pair with cognate nucleotides of the opposite strand). (Exemplary DsiRNA molecules of the invention are shown in FIG. 1, and below.)

In related embodiments, a dsNA of the invention possesses strand lengths that are, independently, between 19 and 66 nucleotides in length, optionally between 25 and 53 nucleotides in length, e.g., 19, 20, 21, 22, 23, 24, 25, 26, 27, 28, 29, 30, 31, 32, 33, 34, 35, 36, 37, 38, 39, 40, 41, 42, 43, 44, 45, 46, 47, 48 or 49, 50, 51, 52, 53, 54, 55, 56, 57, 58, 59, 60, 61, 62, 63, 64, 65, 66 nucleotides in length. In certain embodiments, one strand length is 19-35 nucleotides in length, while the other strand length is 30-66 nucleotides in length and at least one strand has a 5' overhang of at least 5 nucleotides in length relative to the other strand. In certain related embodiments, the 3' end of the first strand and the 5' end of the second strand form a structure that is a blunt end or a 1-6 nucleotide 3' overhang, while the 5' end of the first strand forms a 5-35 nucleotide overhang with respect to the 3' end of the second strand. Optionally, between one and all nucleotides of the 5-35 nucleotide overhang are modified nucleotides (optionally, deoxyribonucleotides and/or modified ribonucleotides, or otherwise modified as described elsewhere herein).

In some embodiments, a dsNA of the invention has a first or second strand that has at least 8 contiguous ribonucleotides. In certain embodiments, a dsNA of the invention has 9, 10, 11, 12, 13, 14, 15, 16, 17, 18, 19, 20, 21, 22, 23 or more (e.g., 24, 25, 26, 27, 28, 29, 30, 31, 32, 33, 34, 35, 26, or more, up to the full length of the strand) ribonucleotides, optionally including modified ribonucleotides (2'-O-methyl ribonucleotides, phosphorothioate linkages, etc.). In certain embodiments, the ribonucleotides or modified ribonucleotides are contiguous.

In certain embodiments of the invention, tetraloop- and modified nucleotide-containing dsNAs are contemplated as described, e.g., in US 2011/0288147. In certain such embodiments, a dsNA of the invention possesses a first strand and a second strand, where the first strand and the second strand form a duplex region of 19-25 nucleotides in length, wherein the first strand comprises a 3' region that extends beyond the first strand-second strand duplex region and comprises a tetraloop, and the dsNA comprises a discontinuity between the 3' terminus of the first strand and the 5' terminus of the second strand. Optionally, the discontinuity is positioned at a projected dicer cleavage site of the tetraloop-containing dsNA. It is contemplated that, as for any of the other dupexed oligonucleotides of the invention, tetraloop-containing duplexes of the invention can possess any range of modifications disclosed herein or otherwise known in the art, including, e.g., 2'-O-methyl, 2'-fluoro, inverted base, GalNAc moieties, etc. Typically, every nucleotide on both strands of the tetraloop-containing dsNA is chemically modified if the tetraloop-containing dsNA is going to be delivered without using lipid nanoparticles or some other delivery method that protects the dsNA from degradation during the delivery process. However, in certain embodiments, one or more nucleotides are not modified.

Figure 6:
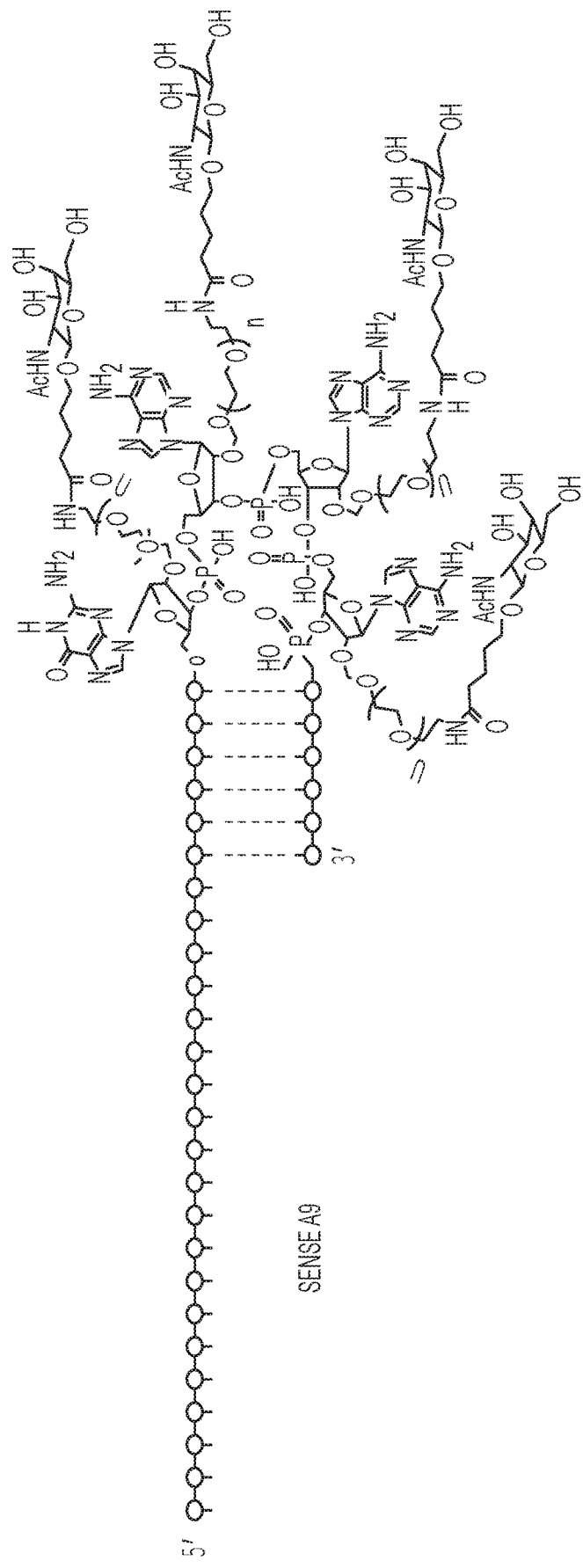
FIG. 6 shows an exemplary diagram demonstrating production of a GalNAc-possessing tetraloop-configured agent.
Figure 6:
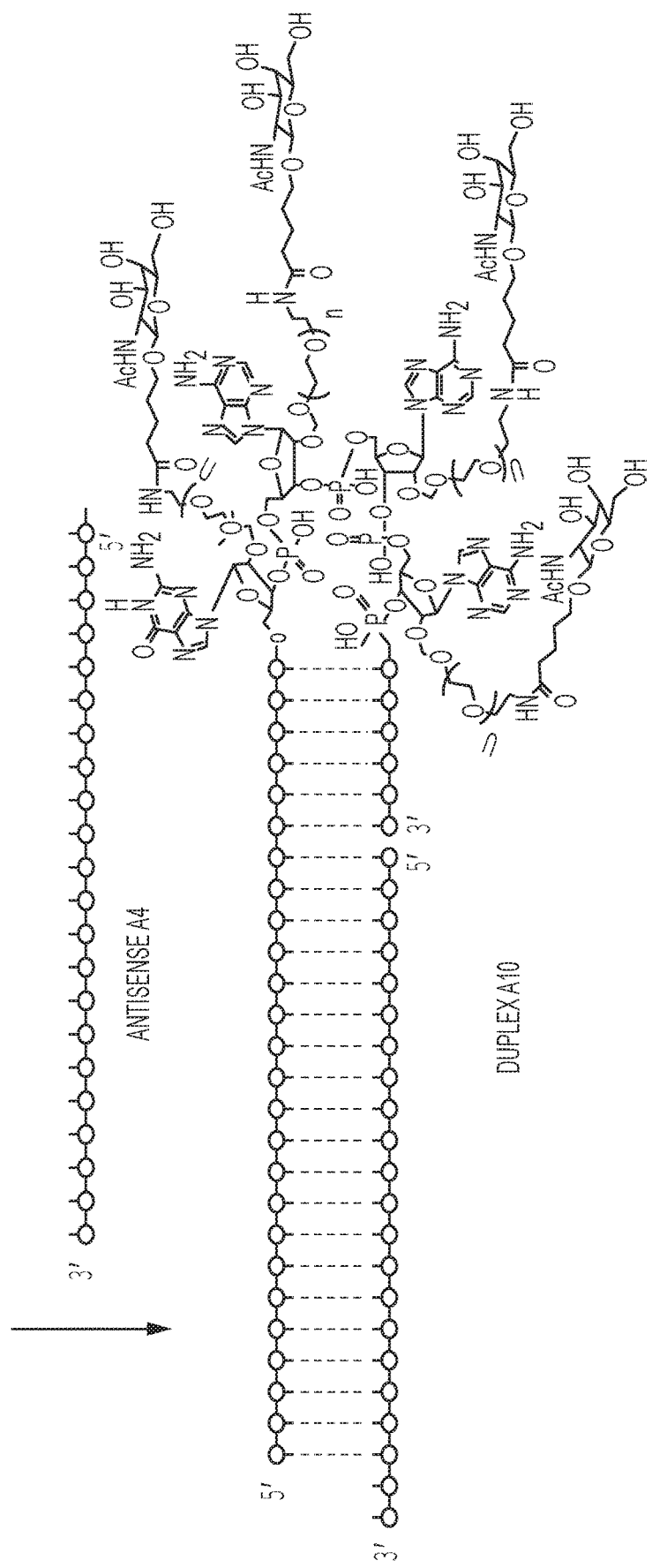

A dsNA agent of the invention can be conjugated to another moiety, such as (but not limited to) a peptide, small molecule, or a carbohydrate. Modifying dsNA agents in this way may improve cellular uptake or enhance cellular targeting activities of the resulting dsNA agent derivative as compared to the corresponding unconjugated dsNA agent, are useful for tracing the dsNA agent derivative in the cell, or improve the stability of the dsNA agent derivative compared to the corresponding unconjugated dsNA agent. dsNAs of the invention may be conjugated to moieties such as (but not limited to) GalNAc, folate, cholesterol and/or mannose-6-phosphate. In one embodiment, a single dsNA of the invention comprises more than one GalNAc molecule, optionally more than one folate molecule and/or more than one cholesterol molecule and optionally more than one mannose-6-phosphate molecule, or any combination of the previous conjugates. In certain embodiments, a tetraloop-containing agent of the invention comprises three or four GalNAc molecules conjugated to the agent. In certain of those embodiments, there is a GalNAc molecule conjugated to each of four tetraloop nucleotides in the tetraloop-containing agent (see FIG. 6 for an example of this).

Ligands, such as GalNAc, not only can be attached to the nucleobase of the nucleoside monomer (i.e. C5 position of Thymidine), but also can be attached to the ribose sugar via 2'-OH (or 3'-OH) with a linker. 2'-OH as a conjugation site is particularly useful in the case of tetraloop-containing dsNAs because the 2'-OHs of the four nucleotides in the loop are exposed to the solvent and are not involved in hydrogen bonding and base stacking, which is needed for forming the stable loop based on their crystal structure.

In certain embodiments, a dsNA comprising a first strand and a second strand, each strand, independently, having a 5' terminus and a 3' terminus, and having, independently, respective strand lengths of 25-53 nucleotides in length, is sufficiently highly modified (e.g., at least 10% or more, at least 20% or more, at least 30% or more, at least 40% or more, at least 50% or more, at least 60% or more, at least 70% or more, at least 80% or more, at least 90% or more, at least 95% or more residues of one and/or both strands are modified such that dicer cleavage of the dsNA is prevented (optionally, modified residues occur at and/or flanking one or all predicted dicer cleavage sites of the dsNA). Such non-dicer-cleaved dsNAs retain AT3 inhibition activity and are optionally cleaved by non-dicer nucleases to yield, e.g., 15-30, or in particular embodiments, 19-23 nucleotide strand length dsNAs capable of inhibiting AT3 in a mammalian cell. In certain related embodiments, dsNAs possessing sufficiently extensive modification to block dicer cleavage of such dsNAs optionally possess regions of unmodified nucleotide residues (e.g., one or two or more consecutive nucleotides, forming a "gap" or "window" in a modification pattern) that allow for and/or promote cleavage of such dsNAs by non-Dicer nucleases. In other embodiments, Dicer-cleaved dsNAs of the invention can include extensive modification patterns that possess such "windows" or "gaps" in modification such that Dicer cleavage preferentially occurs at such sites (as compared to heavily modified regions within such dsNAs).

In certain embodiments of the present invention, an oligonucleotide is provided (optionally, as a free antisense oligonucleotide or as an oligonucleotide of a double-stranded or other multiple-stranded structure) that includes a sequence complementary to the AT3 target as described elsewhere herein and that is 15 to 80 nucleotides in length, e.g., in specific embodiments 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79 or 80 nucleotides in length.

In certain additional embodiments of the present invention, each oligonucleotide of a DsiRNA molecule of the invention is independently 25 to 53 nucleotides in length, in specific embodiments 25, 26, 27, 28, 29, 30, 31, 32, 33, 34, 35, 36, 37, 38, 39, 40, 41, 42, 43, 44, 45, 46, 47, 48, 49, 50, 51, 52 or 53 nucleotides in length. For DsiRNAs possessing a strand that exceeds 30 nucleotides in length, available structures include those where only one strand exceeds 30 nucleotides in length (see, e.g., U.S. Pat. No. 8,349,809), or those where both strands exceed 30 nucleotides in length (see, e.g., WO 2010/080129). Stabilizing modifications (e.g., 2'-O-Methyl, phosphorothioate, deoxyribonucleotides, including dNTP base pairs, 2'-F, etc.) can be incorporated within any double stranded nucleic acid of the invention, and can be used in particular within DsiRNAs possessing one or both strands exceeding 30 nucleotides in length. While the guide strand of a double stranded nucleic acid of the invention must possess a sequence of, e.g., 15, 16, 17, 18 or 19 nucleotides that are complementary to a target RNA (e.g., mRNA), additional sequence(s) of the guide strand need not be complementary to the target RNA. The end structures of double stranded nucleic acids possessing at least one strand length in excess of 30 nucleotides can also be varied while continuing to yield functional dsNAs—e.g. the 5' end of the guide strand and the 3' end of the passenger strand may form a 5'-overhang, a blunt end or a 3' overhang (for certain dsNAs, e.g., "single strand extended" dsNAs, the length of such a 5' or 3' overhang can be 1-4, 1-5, 1-6, 1-10, 1-15, 1-20 or even 1-25 or more nucleotides); similarly, the 3' end of the guide strand and the 5' end of the passenger strand may form a 5'-overhang, a blunt end or a 3' overhang (for certain dsNAs, e.g., "single strand extended" dsNAs, the length of such a 5' or 3' overhang can be 1-4, 1-5, 1-6, 1-10, 1-15, 1-20 or even 1-25 or more nucleotides). In certain embodiments, the 5' end of the passenger strand includes a 5'-overhang relative to the 3' end of the guide strand, such that a one to fifteen or more nucleotide single strand extension exists.

Optionally, such single strand extensions of the dsNAs of the invention (whether present on the passenger or the guide strand) can be modified, e.g., with phosphorothioate (PS), 2'-F, 2'-O-methyl and/or other forms of modification contemplated herein or known in the art, including conjugation to, e.g., GalNAc moieties, inverted abasic residues, etc. In some embodiments, the guide strand of a single-strand extended duplex of the invention is between 35 and 50 nucleotides in length, while the duplex presents a single-strand extension that is seven to twenty nucleotides in length. In certain embodiments, the guide strand of a duplex is between 37 and 42 nucleotides in length and the duplex possesses a 5' single-stranded overhang of the passenger strand that is approximately five to fifteen single-stranded nucleotides in length (optionally, 6, 7, 8, 9, 10, 11, 12, 13, or 14 nucleotides in length). In related embodiments, the passenger strand of the duplex is about 25 to about 30 nucleotides in length. In certain embodiments, the extended region of the duplex can optionally be extensively modified, e.g., with one or more of 2'-O-methyl, 2'-Fluoro, GalNAc moieties, phosphorothioate internucleotide linkages, inverted abasic residues, etc. In certain embodiments, the length of the passenger strand is 31-49 nucleotides while the length of the guide strand is 31-53 nucleotides, optionally while the 5' end of the guide strand forms a blunt end (optionally, a base-paired blunt end) with the 3' end of the passenger strand, optionally, with the 3' end of the guide strand and the 5' end of the passenger strand forming a 3' overhang of 1-4 nucleotides in length.

Exemplary "extended" Dicer substrate structures are set forth, e.g., in US 2010/0173974 and U.S. Pat. No. 8,349,809, both of which are incorporated herein by reference. In certain embodiments, one or more strands of the dsNA molecule of the invention independently comprises 19 to 35 nucleotides (e.g., 19, 20, 21, 22, 23, 24, 25, 26, 27, 28, 29, 30, 31, 32, 33, 34 or 35) that are complementary to a target (AT3) nucleic acid molecule. In certain embodiments, a DsiRNA molecule of the invention possesses a length of duplexed nucleotides between 25 and 49 nucleotides in length (e.g., 25, 26, 27, 28, 29, 30, 31, 32, 33, 34, 35, 36, 37, 38, 39, 40, 41, 42, 43, 44, 45, 46, 47, 48 or 49 nucleotides in length; optionally, all such nucleotides base pair with cognate nucleotides of the opposite strand).

In a further embodiment of the present invention, each oligonucleotide of a DsiRNA molecule of the invention is independently 19 to 66 nucleotides in length, in specific embodiments 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65 or 66 nucleotides in length. For dsNAs possessing a strand that exceeds 30 nucleotides in length, available structures include those where only one strand exceeds 30 nucleotides in length (see, e.g., U.S. Pat. No. 8,349,809, where an exemplary double stranded nucleic acid possesses a first oligonucleotide strand having a 5' terminus and a 3' terminus and a second oligonucleotide strand having a 5' terminus and a 3' terminus, where each of the 5' termini has a 5' terminal nucleotide and each of the 3' termini has a 3' terminal nucleotide, where the first strand (or the second strand) is 25-30 nucleotide residues in length, where starting from the 5' terminal nucleotide (position 1) positions 1 to 23 of the first strand (or the second strand) include at least 8 ribonucleotides; the second strand (or the first strand) is 36-66 nucleotides residues in length and, starting from the 3' terminal nucleotide, includes at least 8 ribonucleotides in the positions paired with positions 1-23 of the first strand to form a duplex; where at least the 3' terminal nucleotide of the second strand (or the first strand) is unpaired with the first strand (or the second strand), and up to 6 consecutive 3' terminal nucleotides are unpaired with the first strand (or the second strand), thereby forming a 3' single stranded overhang of 1-6 nucleotides; where the 5' terminus of the second strand (or the first strand) includes from 10-30 consecutive nucleotides which are unpaired with the first strand (or the second strand), thereby forming a 10-30 nucleotide single stranded 5' overhang; where at least the first strand (or the second strand) 5' terminal and 3' terminal nucleotides are base paired with nucleotides of the second strand (or first strand) when the first and second strands are aligned for maximum complementarity, thereby forming a substantially duplexed region between the first and second strands; and the second strand is sufficiently complementary to a target RNA along at least 19 ribonucleotides of the second strand length to reduce target gene expression when the double stranded nucleic acid is introduced into a mammalian cell), or those where both strands exceed 30 nucleotides in length (see, e.g., U.S. Pat. No. 8,513,207, where an exemplary double stranded nucleic acid (dsNA) possesses a first oligonucleotide strand having a 5' terminus and a 3' terminus and a second oligonucleotide strand having a 5' terminus and a 3' terminus, where the first strand is 31 to 49 nucleotide residues in length, where starting from the first nucleotide (position 1) at the 5' terminus of the first strand, positions 1 to 23 of the first strand are ribonucleotides; the second strand is 31 to 53 nucleotide residues in length and includes 23 consecutive ribonucleotides that base pair with the ribonucleotides of positions 1 to 23 of the first strand to form a duplex; the 5' terminus of the first strand and the 3' terminus of said second strand form a blunt end or a 1-4 nucleotide 3' overhang; the 3' terminus of the first strand and the 5' terminus of said second strand form a duplexed blunt end, a 5' overhang or a 3' overhang; optionally, at least one of positions 24 to the 3' terminal nucleotide residue of the first strand is a deoxyribonucleotide, optionally, that base pairs with a deoxyribonucleotide of said second strand; and the second strand is sufficiently complementary to a target RNA along at least 19 ribonucleotides of the second strand length to reduce target gene expression when the double stranded nucleic acid is introduced into a mammalian cell).

In certain embodiments, an active dsNA of the invention can possess a 5' overhang of the first strand (optionally, the passenger strand) with respect to the second strand (optionally, the guide strand) of 2-50 nucleotides (e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50) or more in length. In related embodiments, the duplex region formed by the first and second strands of such a dsNA is 15, 16, 17, 18, 19, 20, 21, 22, 23, 24, 25 or more base pairs in length. The 5' overhang "extended" region of the first strand is optionally modified at one or more residues (optionally, at alternating residues, all residues, or any other selection of residues).

In certain embodiments, an active dsNA of the invention can possess a 3' overhang of the first strand (optionally, the passenger strand) with respect to the second strand (optionally, the guide strand) of 2-50 nucleotides (e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50) or more in length. In related embodiments, the duplex region formed by the first and second strands of such a dsNA is 15, 16, 17, 18, 19, 20, 21, 22, 23, 24, 25 or more base pairs in length. The 3' overhang "extended" region of the first strand is optionally modified at one or more residues (optionally, at alternating residues, all residues, or any other selection of residues).

In additional embodiments, an active dsNA of the invention can possess a 5' overhang of the second strand (optionally, the guide strand) with respect to the first strand (optionally, the passenger strand) of 2-50 nucleotides (e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50) or more in length. In related embodiments, the duplex region formed by the first and second strands of such a dsNA is 15, 16, 17, 18, 19, 20, 21, 22, 23, 24, 25 or more base pairs in length. The 5' overhang "extended" region of the second strand is optionally modified at one or more residues (optionally, at alternating residues, all residues, or any other selection of residues).

In further embodiments, an active dsNA of the invention can possess a 3' overhang of the second strand (optionally, the guide strand) with respect to the first strand (optionally, the passenger strand) of 2-50 nucleotides (e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50) or more in length. In related embodiments, the duplex region formed by the first and second strands of such a dsNA is 15, 16, 17, 18, 19, 20, 21, 22, 23, 24, 25 or more base pairs in length. The 3' overhang "extended" region of the second strand is optionally modified at one or more residues (optionally, at alternating residues, all residues, or any other selection of residues).

In another embodiment of the present invention, each sequence of a DsiRNA molecule of the invention is independently 25 to 35 nucleotides in length, in specific embodiments 25, 26, 27, 28, 29, 30, 31, 32, 33, 34 or 35 nucleotides in length. In another embodiment, the DsiRNA duplexes of the invention independently comprise 25 to 30 base pairs (e.g., 25, 26, 27, 28, 29, or 30). In another embodiment, one or more strands of the DsiRNA molecule of the invention independently comprises 19 to 35 nucleotides (e.g., 19, 20, 21, 22, 23, 24, 25, 26, 27, 28, 29, 30, 31, 32, 33, 34 or 35) that are complementary to a target (AT3) nucleic acid molecule. In certain embodiments, a DsiRNA molecule of the invention possesses a length of duplexed nucleotides between 25 and 34 nucleotides in length (e.g., 25, 26, 27, 28, 29, 30, 31, 32, 33 or 34 nucleotides in length; optionally, all such nucleotides base pair with cognate nucleotides of the opposite strand). (Exemplary DsiRNA molecules of the invention are shown in FIG. 1, and below.)

In certain embodiments, at least 10%, at least 20%, at least 30%, at least 35%, at least 40%, at least 45%, at least 50%, at least 55%, at least 60%, at least 65%, at least 70%, at least 75%, at least 80%, at least 85%, at least 90%, at least 95% or more of the nucleotide residues of a nucleic acid of the instant invention are modified residues. For a dsNA of the invention, at least 10%, at least 20%, at least 30%, at least 35%, at least 40%, at least 45%, at least 50%, at least 55%, at least 60%, at least 65%, at least 70%, at least 75%, at least 80%, at least 85%, at least 90%, at least 95% or more of the nucleotide residues of the first strand are modified residues. Additionally and/or alternatively for a dsNA of the invention, at least 10%, at least 20%, at least 30%, at least 35%, at least 40%, at least 45%, at least 50%, at least 55%, at least 60%, at least 65%, at least 70%, at least 75%, at least 80%, at least 85%, at least 90%, at least 95% or more of the nucleotide residues of the second strand are modified residues. For the dsNAs of the invention, modifications of both duplex (double-stranded) regions and overhang (single-stranded) regions are contemplated. Thus, in certain embodiments, at least 10%, at least 20%, at least 30%, at least 35%, at least 40%, at least 45%, at least 50%, at least 55%, at least 60%, at least 65%, at least 70%, at least 75%, at least 80%, at least 85%, at least 90%, at least 95% or more (e.g., all) duplex nucleotide residues are modified residues. Additionally and/or alternatively, at least 10%, at least 20%, at least 30%, at least 35%, at least 40%, at least 45%, at least 50%, at least 55%, at least 60%, at least 65%, at least 70%, at least 75%, at least 80%, at least 85%, at least 90%, at least 95% or more (e.g., all) overhang nucleotide residues of one or both strands are modified residues. Optionally, the modifications of the dsNAs of the invention do not include an inverted abasic (e.g., inverted deoxy abasic) or inverted dT end-protecting group. Alternatively, a dsNA of the invention includes a terminal cap moiety (e.g., an inverted deoxy abasic and/or inverted dT end-protecting group). Optionally, such a terminal cap moiety is located at the 5' end, at the 3' end, or at both the 5' end and the 3' end of the first strand, of the second strand, or of both first and second strands.

As used herein "cell" is used in its usual biological sense, and does not refer to an entire multicellular organism, e.g., specifically does not refer to a human. The cell can be present in an organism, e.g., birds, plants and mammals such as humans, cows, sheep, apes, monkeys, swine, dogs, and cats. The cell can be prokaryotic (e.g., bacterial cell) or eukaryotic (e.g., mammalian or plant cell). The cell can be of somatic or germ line origin, totipotent or pluripotent, dividing or non-dividing. The cell can also be derived from or can comprise a gamete or embryo, a stem cell, or a fully differentiated cell. Within certain aspects, the term "cell" refers specifically to mammalian cells, such as human cells, that contain one or more isolated dsRNA molecules of the present disclosure. In particular aspects, a cell processes dsRNAs or dsRNA-containing molecules resulting in RNA intereference of target nucleic acids, and contains proteins and protein complexes required for RNAi, e.g., Dicer and RISC.

In certain embodiments, dsRNAs of the invention are Dicer substrate siRNAs ("DsiRNAs"). DsiRNAs can possess certain advantages as compared to inhibitory nucleic acids that are not dicer substrates ("non-DsiRNAs"). Such advantages include, but are not limited to, enhanced duration of effect of a DsiRNA relative to a non-DsiRNA, as well as enhanced inhibitory activity of a DsiRNA as compared to a non-DsiRNA (e.g., a 19-23mer siRNA) when each inhibitory nucleic acid is suitably formulated and assessed for inhibitory activity in a mammalian cell at the same concentration (in this latter scenario, the DsiRNA would be identified as more potent than the non-DsiRNA). Detection of the enhanced potency of a DsiRNA relative to a non-DsiRNA is often most readily achieved at a formulated concentration (e.g., transfection concentration of the dsRNA) that results in the DsiRNA eliciting approximately 30-70% knockdown activity upon a target RNA (e.g., a mRNA). For active DsiRNAs, such levels of knockdown activity are most often achieved at in vitro mammalian cell DsiRNA transfection concentrations of 1 nM or less of as suitably formulated, and in certain instances are observed at DsiRNA transfection concentrations of 200 pM or less, 100 pM or less, 50 pM or less, 20 pM or less, 10 pM or less, 5 pM or less, or even 1 pM or less. Indeed, due to the variability among DsiRNAs of the precise concentration at which 30-70% knockdown of a target RNA is observed, construction of an $IC_{50}$ curve via assessment of the inhibitory activity of DsiRNAs and non-DsiRNAs across a range of effective concentrations is a preferred method for detecting the enhanced potency of a DsiRNA relative to a non-DsiRNA inhibitory agent.

In certain embodiments, a DsiRNA (in a state as initially formed, prior to dicer cleavage) is more potent at reducing AT3 target gene expression in a mammalian cell than a 19, 20, 21, 22 or 23 base pair sequence that is contained within it. In certain such embodiments, a DsiRNA prior to dicer cleavage is more potent than a 19-21mer contained within it. Optionally, a DsiRNA prior to dicer cleavage is more potent than a 19 base pair duplex contained within it that is synthesized with symmetric dTdT overhangs (thereby forming a siRNA possessing 21 nucleotide strand lengths having dTdT overhangs). In certain embodiments, the DsiRNA is more potent than a 19-23mer siRNA (e.g., a 19 base pair duplex with dTdT overhangs) that targets at least 19 nucleotides of the 21 nucleotide target sequence that is recited for a DsiRNA of the invention (without wishing to be bound by theory, the identity of a such a target site for a DsiRNA is identified via identification of the Ago2 cleavage site for the DsiRNA; once the Ago2 cleavage site of a DsiRNA is determined for a DsiRNA, identification of the Ago2 cleavage site for any other inhibitory dsRNA can be performed and these Ago2 cleavage sites can be aligned, thereby determining the alignment of projected target nucleotide sequences for multiple dsRNAs). In certain related embodiments, the DsiRNA is more potent than a 19-23mer siRNA that targets at least 20 nucleotides of the 21 nucleotide target sequence that is recited for a DsiRNA of the invention. Optionally, the DsiRNA is more potent than a 19-23mer siRNA that targets the same 21 nucleotide target sequence that is recited for a DsiRNA of the invention. In certain embodiments, the DsiRNA is more potent than any 21mer siRNA that targets the same 21 nucleotide target sequence that is recited for a DsiRNA of the invention. Optionally, the DsiRNA is more potent than any 21 or 22mer siRNA that targets the same 21 nucleotide target sequence that is recited for a DsiRNA of the invention. In certain embodiments, the DsiRNA is more potent than any 21, 22 or 23mer siRNA that targets the same 21 nucleotide target sequence that is recited for a DsiRNA of the invention. As noted above, such potency assessments are most effectively performed upon dsRNAs that are suitably formulated (e.g., formulated with an appropriate transfection reagent) at a concentration of 1 nM or less. Optionally, an $IC_{50}$ assessment is performed to evaluate activity across a range of effective inhibitory concentrations, thereby allowing for robust comparison of the relative potencies of dsRNAs so assayed.

The dsRNA molecules of the invention are added directly, or can be complexed with lipids (e.g., cationic lipids), packaged within liposomes, or otherwise delivered to target cells or tissues. The nucleic acid or nucleic acid complexes can be locally administered to relevant tissues ex vivo, or in vivo through direct dermal application, transdermal application, or injection, with or without their incorporation in biopolymers. In particular embodiments, the nucleic acid molecules of the invention comprise sequences shown in FIG. 1, and the below exemplary structures. Examples of such nucleic acid molecules consist essentially of sequences defined in these figures and exemplary structures. Furthermore, where such agents are modified in accordance with the below description of modification patterning of DsiRNA agents, chemically modified forms of constructs described in FIG. 1, and the below exemplary structures can be used in all uses described for the DsiRNA agents of FIG. 1, and the below exemplary structures.

In another aspect, the invention provides mammalian cells containing one or more dsRNA molecules of this invention. The one or more dsRNA molecules can independently be targeted to the same or different sites.

By "RNA" is meant a molecule comprising at least one, and preferably at least 4, 8 and 12 ribonucleotide residues. The at least 4, 8 or 12 RNA residues may be contiguous. By "ribonucleotide" is meant a nucleotide with a hydroxyl group at the 2' position of a R-D-ribofuranose moiety. The terms include double-stranded RNA, single-stranded RNA, isolated RNA such as partially purified RNA, essentially pure RNA, synthetic RNA, recombinantly produced RNA, as well as altered RNA that differs from naturally occurring RNA by the addition, deletion, substitution and/or alteration of one or more nucleotides. Such alterations can include addition of non-nucleotide material, such as to the end(s) of the dsRNA or internally, for example at one or more nucleotides of the RNA. Nucleotides in the RNA molecules of the instant invention can also comprise non-standard nucleotides, such as non-naturally occurring nucleotides or chemically synthesized nucleotides or deoxynucleotides. These altered RNAs can be referred to as analogs or analogs of naturally-occurring RNA.

By "subject" is meant an organism, which is a donor or recipient of explanted cells or the cells themselves. "Subject" also refers to an organism to which the dsRNA agents of the invention can be administered. A subject can be a mammal or mammalian cells, including a human or human cells.

The phrase "pharmaceutically acceptable carrier" refers to a carrier for the administration of a therapeutic agent. Exemplary carriers include saline, buffered saline, dextrose, water, glycerol, ethanol, and combinations thereof. For drugs administered orally, pharmaceutically acceptable carriers include, but are not limited to pharmaceutically acceptable excipients such as inert diluents, disintegrating agents, binding agents, lubricating agents, sweetening agents, flavoring agents, coloring agents and preservatives. Suitable inert diluents include sodium and calcium carbonate, sodium and calcium phosphate, and lactose, while corn starch and alginic acid are suitable disintegrating agents. Binding agents may include starch and gelatin, while the lubricating agent, if present, will generally be magnesium stearate, stearic acid or talc. If desired, the tablets may be coated with a material such as glyceryl monostearate or glyceryl distearate, to delay absorption in the gastrointestinal tract. The pharmaceutically acceptable carrier of the disclosed dsRNA compositions may be micellar structures, such as a liposomes, capsids, capsoids, polymeric nanocapsules, or polymeric microcapsules.

Polymeric nanocapsules or microcapsules facilitate transport and release of the encapsulated or bound dsRNA into the cell. They include polymeric and monomeric materials, especially including polybutylcyanoacrylate. A summary of materials and fabrication methods has been published (see Kreuter, 1991). The polymeric materials which are formed from monomeric and/or oligomeric precursors in the polymerization/nanoparticle generation step, are per se known from the prior art, as are the molecular weights and molecular weight distribution of the polymeric material which a person skilled in the field of manufacturing nanoparticles may suitably select in accordance with the usual skill.

Various methodologies of the instant invention include step that involves comparing a value, level, feature, characteristic, property, etc. to a "suitable control", referred to interchangeably herein as an "appropriate control". A "suitable control" or "appropriate control" is a control or standard familiar to one of ordinary skill in the art useful for comparison purposes. In one embodiment, a "suitable control" or "appropriate control" is a value, level, feature, characteristic, property, etc. determined prior to performing an RNAi methodology, as described herein. For example, a transcription rate, mRNA level, translation rate, protein level, biological activity, cellular characteristic or property, genotype, phenotype, etc. can be determined prior to introducing an RNA silencing agent (e.g., DsiRNA) of the invention into a cell or organism. In another embodiment, a "suitable control" or "appropriate control" is a value, level, feature, characteristic, property, etc. determined in a cell or organism, e.g., a control or normal cell or organism, exhibiting, for example, normal traits. In yet another embodiment, a "suitable control" or "appropriate control" is a predefined value, level, feature, characteristic, property, etc.

The term "in vitro" has its art recognized meaning, e.g., involving purified reagents or extracts, e.g., cell extracts. The term "in vivo" also has its art recognized meaning, e.g., involving living cells, e.g., immortalized cells, primary cells, cell lines, and/or cells in an organism.

"Treatment", or "treating" as used herein, is defined as the application or administration of a therapeutic agent (e.g., a dsRNA agent or a vector or transgene encoding same) to a patient, or application or administration of a therapeutic agent to an isolated tissue or cell line from a patient, who has a disorder with the purpose to cure, heal, alleviate, relieve, alter, remedy, ameliorate, improve or affect the disease or disorder, or symptoms of the disease or disorder. The term "treatment" or "treating" is also used herein in the context of administering agents prophylactically. The term "effective dose" or "effective dosage" is defined as an amount sufficient to achieve or at least partially achieve the desired effect. The term "therapeutically effective dose" is defined as an amount sufficient to cure or at least partially arrest the disease and its complications in a patient already suffering from the disease. The term "patient" includes human and other mammalian subjects that receive either prophylactic or therapeutic treatment.

Structures of Anti-AT3 DsiRNA Agents

In certain embodiments, the anti-AT3 DsiRNA agents of the invention can have the following structures:

In one such embodiment, the DsiRNA comprises:

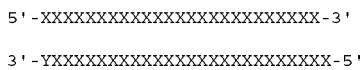

wherein "X"=RNA and "Y" is an overhang domain comprised of 1-4 RNA monomers that are optionally 2'-O-methyl RNA monomers. In a related embodiment, the DsiRNA comprises:

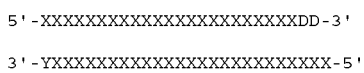

wherein "X"=RNA, "Y" is an overhang domain comprised of 1-4 RNA monomers that are optionally 2'-O-methyl RNA monomers, and "D"=DNA. In one embodiment, the top strand is the sense strand, and the bottom strand is the antisense strand. Alternatively, the bottom strand is the sense strand and the top strand is the antisense strand.

DsiRNAs of the invention can carry a broad range of modification patterns (e.g., 2'-O-methyl RNA patterns, e.g., within extended DsiRNA agents). Certain modification patterns of the second strand of DsiRNAs of the invention are presented below.

In one embodiment, the DsiRNA comprises:

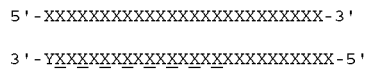

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

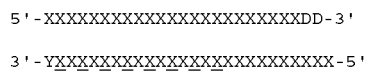

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers, and "D"=DNA. The top strand is the sense strand, and the bottom strand is the antisense strand.

In another such embodiment, the DsiRNA comprises:

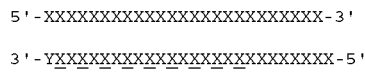

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

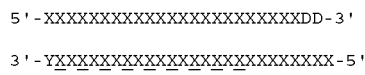

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand.

In another such embodiment, the DsiRNA comprises:

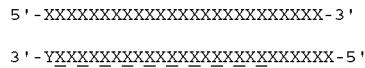

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

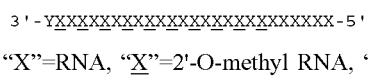

wherein "X"=RNA, "X"=2'-O-methyl RNA, "Y" an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand.

In further embodiments, the DsiRNA comprises:

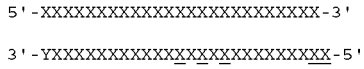

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

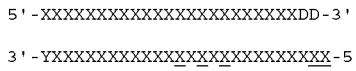

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

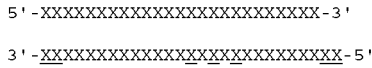

wherein "X"=RNA and "X"=2'-O-methyl RNA. In a further related embodiment, the DsiRNA comprises:

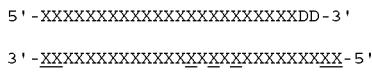

wherein "X"=RNA, "X"=2'-O-methyl RNA, and "D"=DNA. The top strand is the sense strand, and the bottom strand is the antisense strand. This modification pattern is also referred to herein as the "AS-M7" or "M7" modification pattern.

In additional embodiments, the DsiRNA comprises:

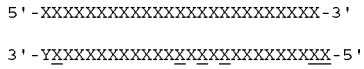

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

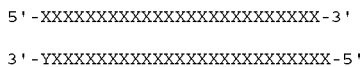

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. The top strand is the sense strand, and the bottom strand is the antisense strand. In another related embodiment, the DsiRNA comprises:

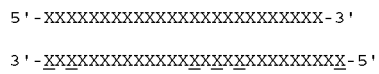

wherein "X"=RNA and "X"=2'-O-methyl RNA. The top strand is the sense strand, and the bottom strand is the antisense strand. In a further related embodiment, the DsiRNA comprises:

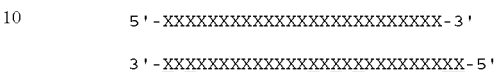

wherein "X"=RNA, "X"=2'-O-methyl RNA, and "D"=DNA. The top strand is the sense strand, and the bottom strand is the antisense strand. This modification pattern is also referred to herein as the "AS-M6" or "M6" modification pattern.

In other embodiments, the DsiRNA comprises:

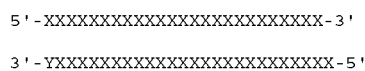

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

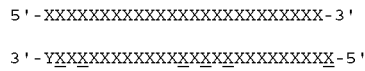

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

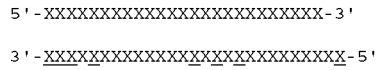

wherein "X"=RNA and "X"=2'-O-methyl RNA. The top strand is the sense strand, and the bottom strand is the antisense strand. In another related embodiment, the DsiRNA comprises:

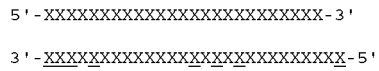

wherein "X"=RNA, "X"=2'-O-methyl RNA, and "D"=DNA. The top strand is the sense strand, and the bottom strand is the antisense strand. This modification pattern is also referred to herein as the "AS-M5" or "M5" modification pattern.

In further embodiments, the DsiRNA comprises:

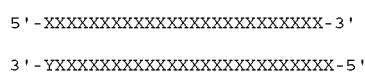

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M4" or "M4" modification pattern.

In additional embodiments, the DsiRNA comprises:

```
5'-XXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M8" or "M8" modification pattern.

In other embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M3" or "M3" modification pattern.

In additional embodiments, the DsiRNA comprises:

```
5'-XXXXXXXXXXXXXXXXXXXXXXXXX-3'
3'-YXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

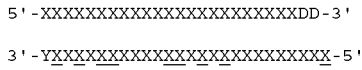

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

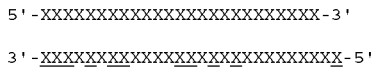

wherein "X"=RNA and "X"=2'-O-methyl RNA. The top strand is the sense strand, and the bottom strand is the antisense strand. In a further related embodiment, the DsiRNA comprises:

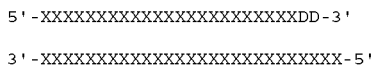

wherein "X"=RNA, "X"=2'-O-methyl RNA, and "D"=DNA. The top strand is the sense strand, and the bottom strand is the antisense strand. This modification pattern is also referred to herein as the "AS-M2" or "M2" modification pattern.

In further embodiments, the DsiRNA comprises:

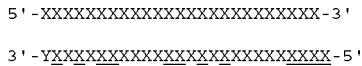

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

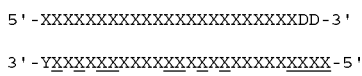

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

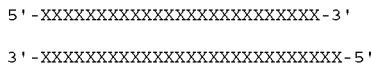

wherein "X"=RNA and "X"=2'-O-methyl RNA. The top strand is the sense strand, and the bottom strand is the antisense strand. In a further related embodiment, the DsiRNA comprises:

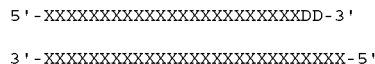

wherein "X"=RNA, "X"=2'-O-methyl RNA, and "D"=DNA. The top strand is the sense strand, and the bottom strand is the antisense strand. This modification pattern is also referred to herein as the "AS-M1" or "M1" modification pattern.

In additional embodiments, the DsiRNA comprises:

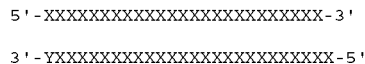

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

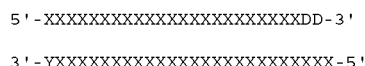

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

wherein "X"=RNA and "X"=2'-O-methyl RNA. The top strand is the sense strand, and the bottom strand is the antisense strand. In a further related embodiment, the DsiRNA comprises:

wherein "X"=RNA, "X"=2'-O-methyl RNA, and "D"=DNA. The top strand is the sense strand, and the bottom strand is the antisense strand. This modification pattern is also referred to herein as the "AS-M9" or "M9" modification pattern.

In other embodiments, the DsiRNA comprises:

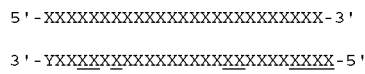

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M10" or "M10" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M11" or "M11" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M12" or "M12" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

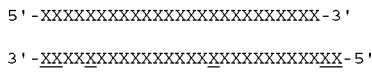

wherein "X"=RNA and "X"=2'-O-methyl RNA. The top strand is the sense strand, and the bottom strand is the antisense strand. In a further related embodiment, the DsiRNA comprises:

wherein "X"=RNA, "X"=2'-O-methyl RNA, and "D"=DN. The top strand is the sense strand, and the bottom strand is the antisense strand. This modification pattern is also referred to herein as the "AS-M13" or "M13" modification pattern.

In other embodiments, the DsiRNA comprises:

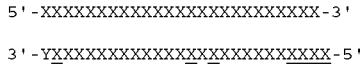

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In another related embodiment, the DsiRNA comprises:

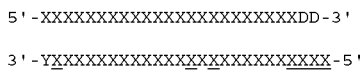

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

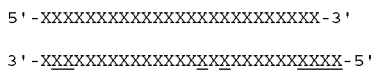

wherein "X"=RNA and "X"=2'-O-methyl RNA. The top strand is the sense strand, and the bottom strand is the antisense strand. In a further related embodiment, the DsiRNA comprises:

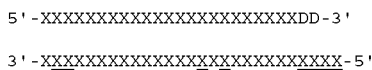

wherein "X"=RNA, "X"=2'-O-methyl RNA, and "D"=DNA. The top strand is the sense strand, and the bottom strand is the antisense strand. This modification pattern is also referred to herein as the "AS-M21" or "M21" modification pattern.

In further embodiments, the DsiRNA comprises:

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

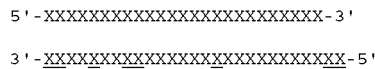

wherein "X"=RNA and "X"=2'-O-methyl RNA. The top strand is the sense strand, and the bottom strand is the antisense strand. In a further related embodiment, the DsiRNA comprises:

wherein "X"=RNA, "X"=2'-O-methyl RNA, and "D"=DNA. The top strand is the sense strand, and the bottom strand is the antisense strand. This modification pattern is also referred to herein as the "AS-M14" or "M14" modification pattern.

In additional embodiments, the DsiRNA comprises:

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

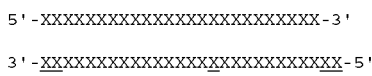

wherein "X"=RNA and "X"=2'-O-methyl RNA. The top strand is the sense strand, and the bottom strand is the antisense strand. In a further related embodiment, the DsiRNA comprises:

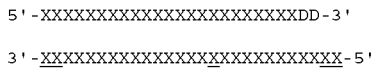

wherein "X"=RNA, "X"=2'-O-methyl RNA, and "D"=DNA. The top strand is the sense strand, and the bottom strand is the antisense strand. This modification pattern is also referred to herein as the "AS-M15" or "M15" modification pattern. In further embodiments, the DsiRNA comprises:

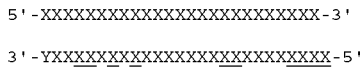

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

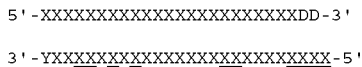

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

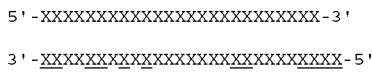

wherein "X"=RNA and "X"=2'-O-methyl RNA. The top strand is the sense strand, and the bottom strand is the antisense strand. In a further related embodiment, the DsiRNA comprises:

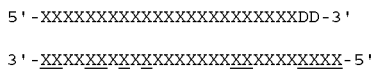

wherein "X"=RNA, "X"=2'-O-methyl RNA, and "D"=DNA. The top strand is the sense strand, and the bottom strand is the antisense strand. This modification pattern is also referred to herein as the "AS-M16" or "M16" modification pattern.

In additional embodiments, the DsiRNA comprises:

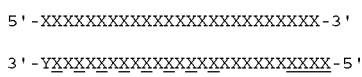

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

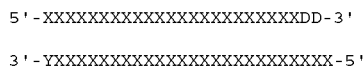

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

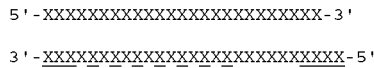

wherein "X"=RNA and "X"=2'-O-methyl RNA. The top strand is the sense strand, and the bottom strand is the antisense strand. In a further related embodiment, the DsiRNA comprises:

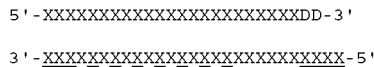

wherein "X"=RNA, "X"=2'-O-methyl RNA, and "D"=DNA. The top strand is the sense strand, and the bottom strand is the antisense strand. This modification pattern is also referred to herein as the "AS-M17" or "M17" modification pattern.

In further embodiments, the DsiRNA comprises:

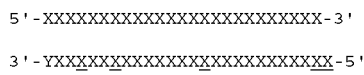

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

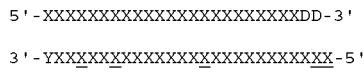

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

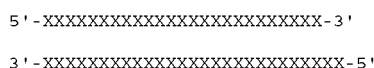

wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-X̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M18" or "M18" modification pattern.

In additional embodiments, the DsiRNA comprises:

```
5'-XXXXXXXXXXXXXXXXXXXXXXXXX-3'
3'-YX̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YX̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-X̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-X̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M19" or "M19" modification pattern.

In further embodiments, the DsiRNA comprises:

```
5'-XXXXXXXXXXXXXXXXXXXXXXXXX-3'
3'-YX̲X̲X̲X̲X̲X̲X̲X̲X̲X̲X̲X̲X̲X̲X̲X̲X̲X̲X̲X̲X̲X̲X̲X̲-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YX̲X̲X̲X̲X̲X̲X̲X̲X̲X̲X̲X̲X̲X̲X̲X̲X̲X̲X̲X̲X̲X̲X̲X̲-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-X̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-X̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M20" or "M20" modification pattern.

In additional embodiments, the DsiRNA comprises:

```
5'-XXXXXXXXXXXXXXXXXXXXXXXXX-3'
3'-YX̲X̲X̲X̲X̲X̲X̲X̲X̲X̲X̲X̲X̲X̲X̲X̲X̲X̲X̲X̲X̲X̲X̲X̲-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YX̲X̲X̲X̲X̲X̲X̲X̲X̲X̲X̲X̲X̲X̲X̲X̲X̲X̲X̲X̲X̲X̲X̲X̲-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-X̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA and "X̲"=2'-O-methyl RNA. The top strand is the sense strand, and the bottom strand is the antisense strand. In a further related embodiment, the DsiRNA comprises:

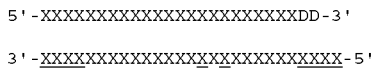

wherein "X"=RNA, "X̲"=2'-O-methyl RNA, and "D"=DNA. The top strand is the sense strand, and the bottom strand is the antisense strand. This modification pattern is also referred to herein as the "AS-M22" or "M22" modification pattern.

In further embodiments, the DsiRNA comprises:

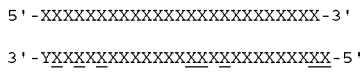

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

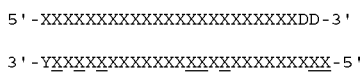

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

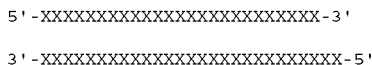

wherein "X"=RNA and "X̲"=2'-O-methyl RNA. The top strand is the sense strand, and the bottom strand is the antisense strand. In a further related embodiment, the DsiRNA comprises:

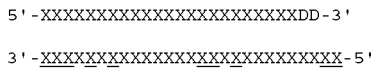

wherein "X"=RNA, "X̲"=2'-O-methyl RNA, and "D"=DNA. The top strand is the sense strand, and the bottom strand is the antisense strand. This modification pattern is also referred to herein as the "AS-M24" or "M24" modification pattern.

In additional embodiments, the DsiRNA comprises:

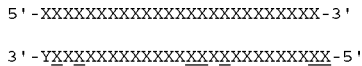

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

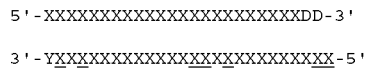

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

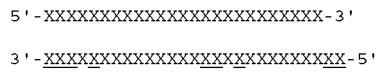

wherein "X"=RNA and "X̲"=2'-O-methyl RNA. The top strand is the sense strand, and the bottom strand is the antisense strand. In a further related embodiment, the DsiRNA comprises:

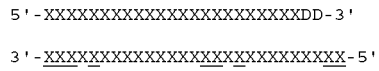

wherein "X"=RNA, "X̲"=2'-O-methyl RNA, and "D"=DNA. The top strand is the sense strand, and the bottom strand is the antisense strand. This modification pattern is also referred to herein as the "AS-M25" or "M25" modification pattern.

In further embodiments, the DsiRNA comprises:

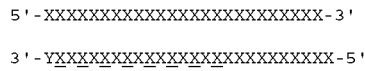

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

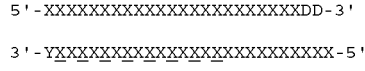

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

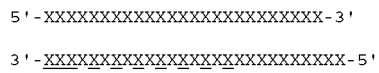

wherein "X"=RNA and "X̲"=2'-O-methyl RNA. The top strand is the sense strand, and the bottom strand is the antisense strand. In a further related embodiment, the DsiRNA comprises:

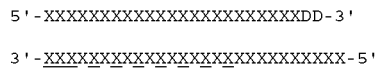

wherein "X"=RNA, "X̲"=2'-O-methyl RNA, and "D"=DNA. The top strand is the sense strand, and the bottom strand is the antisense strand. This modification pattern is also referred to herein as the "AS-M26" or "M26" modification pattern.

In additional embodiments, the DsiRNA comprises:

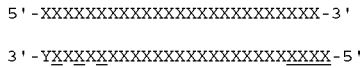

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

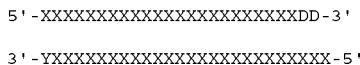

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

wherein "X"=RNA and "X̲"=2'-O-methyl RNA. The top strand is the sense strand, and the bottom strand is the antisense strand. In a further related embodiment, the DsiRNA comprises:

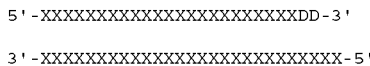

wherein "X"=RNA, "X̲"=2'-O-methyl RNA, and "D"=DNA. The top strand is the sense strand, and the bottom strand is the antisense strand. This modification pattern is also referred to herein as the "AS-M27" or "M27" modification pattern.

In further embodiments, the DsiRNA comprises:

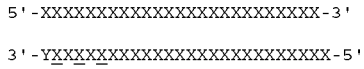

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

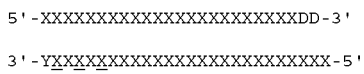

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

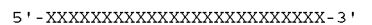
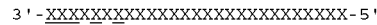

wherein "X"=RNA and "X̲"=2'-O-methyl RNA. The top strand is the sense strand, and the bottom strand is the antisense strand. In a further related embodiment, the DsiRNA comprises:

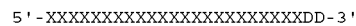
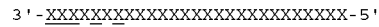

wherein "X"=RNA, "X̲"=2'-O-methyl RNA, and "D"=DNA. The top strand is the sense strand, and the bottom strand is the antisense strand. This modification pattern is also referred to herein as the "AS-M28" or "M28" modification pattern.

In further embodiments, the DsiRNA comprises:

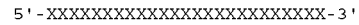
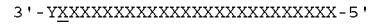

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

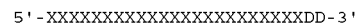
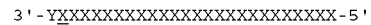

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

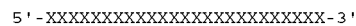
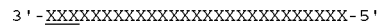

wherein "X"=RNA and "X̲"=2'-O-methyl RNA. The top strand is the sense strand, and the bottom strand is the antisense strand. In a further related embodiment, the DsiRNA comprises:

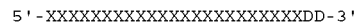
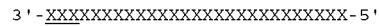

wherein "X"=RNA, "X̲"=2'-O-methyl RNA, and "D"=DNA. The top strand is the sense strand, and the bottom strand is the antisense strand. This modification pattern is also referred to herein as the "AS-M29" or "M29" modification pattern.

In additional embodiments, the DsiRNA comprises:

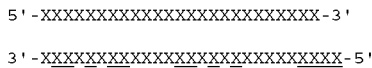

wherein "X"=RNA and "X"=2'-O-methyl RNA. The top strand is the sense strand, and the bottom strand is the antisense strand. In a further related embodiment, the DsiRNA comprises:

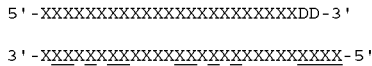

wherein "X"=RNA, "X"=2'-O-methyl RNA, and "D"=DNA. The top strand is the sense strand, and the bottom strand is the antisense strand. This modification pattern is also referred to herein as the "AS-M30" or "M30" modification pattern.

In further embodiments, the DsiRNA comprises:

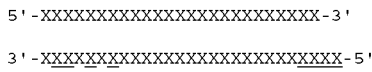

wherein "X"=RNA and "X"=2'-O-methyl RNA. The top strand is the sense strand, and the bottom strand is the antisense strand. In a further related embodiment, the DsiRNA comprises:

wherein "X"=RNA, "X"=2'-O-methyl RNA, and "D"=DNA. The top strand is the sense strand, and the bottom strand is the antisense strand. This modification pattern is also referred to herein as the "AS-M31" or "M31" modification pattern.

In additional embodiments, the DsiRNA comprises:

wherein "X"=RNA and "X"=2'-O-methyl RNA. The top strand is the sense strand, and the bottom strand is the antisense strand. In a further related embodiment, the DsiRNA comprises:

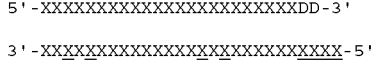

wherein "X"=RNA, "X"=2'-O-methyl RNA, and "D"=DNA. The top strand is the sense strand, and the bottom strand is the antisense strand. This modification pattern is also referred to herein as the "AS-M32" or "M32" modification pattern.

In further embodiments, the DsiRNA comprises:

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

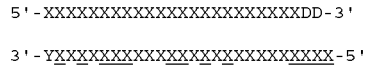

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

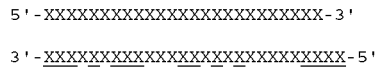

wherein "X"=RNA and "X"=2'-O-methyl RNA. The top strand is the sense strand, and the bottom strand is the antisense strand. In a further related embodiment, the DsiRNA comprises:

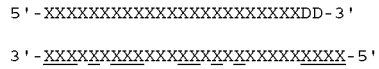

wherein "X"=RNA, "X"=2'-O-methyl RNA, and "D"=DNA. The top strand is the sense strand, and the bottom strand is the antisense strand. This modification pattern is also referred to herein as the "AS-M34" or "M34" modification pattern.

In additional embodiments, the DsiRNA comprises:

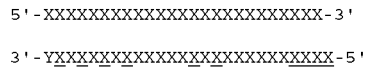

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

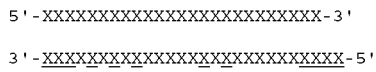

wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M35" or "M35" modification pattern.

In further embodiments, the DsiRNA comprises:

```
5'-XXXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXXX-3'
3'-XXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M37" or "M37" modification pattern.

In additional embodiments, the DsiRNA comprises:

```
5'-XXXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXXX-3'
3'-XXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M38" or "M38" modification pattern.

In further embodiments, the DsiRNA comprises:

```
5'-XXXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXXX-3'
3'-XXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M40" or "M40" modification pattern.

In additional embodiments, the DsiRNA comprises:

```
5'-XXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M41" or "M41" modification pattern.

In further embodiments, the DsiRNA comprises:

```
5'-XXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M36" or "M36" modification pattern.

In additional embodiments, the DsiRNA comprises:

```
5'-XXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M42" or "M42" modification pattern.

In further embodiments, the DsiRNA comprises:

```
5'-XXXXXXXXXXXXXXXXXXXXXXXXX-3'
3'-YX̲XX̲XXXXXXXXXXX̲XX̲XXXXXXXX̲X̲X̲X̲-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YX̲XXXXXXXXXXXX̲XX̲XXXXXXXX̲X̲X̲X̲-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-X̲XXXXXXXXXXXXX̲XX̲XXXXXXXXX̲X̲X̲X̲-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-X̲XXXXXXXXXXXXX̲XX̲XXXXXXXXX̲X̲X̲X̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M43" or "M43" modification pattern.

In additional embodiments, the DsiRNA comprises:

```
5'-XXXXXXXXXXXXXXXXXXXXXXXXX-3'
3'-YX̲XXXXXXXXXXXXX̲XXXXXXXXX̲X̲X̲X̲-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YX̲XXXXXXXXXXXXX̲XXXXXXXXX̲X̲X̲X̲-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-X̲XXXXXXXXXXXXX̲XXXXXXXXXX̲X̲X̲X̲-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-X̲XXXXXXXXXXXXX̲XXXXXXXXXX̲X̲X̲X̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M44" or "M44" modification pattern.

In further embodiments, the DsiRNA comprises:

```
5'-XXXXXXXXXXXXXXXXXXXXXXXXX-3'
3'-YX̲XX̲XX̲XXXXXXXXX̲XX̲XXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YX̲XX̲XX̲XXXXXXXXX̲XX̲XXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XX̲XX̲XX̲XXXXXXXXX̲XX̲XXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XX̲XX̲XX̲XXXXXXXXX̲XX̲XXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M45" or "M45" modification pattern.

In additional embodiments, the DsiRNA comprises:

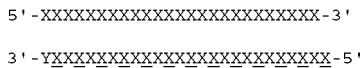

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

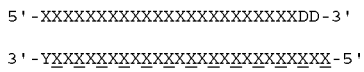

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

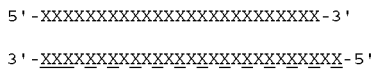

wherein "X"=RNA and "X"=2'-O-methyl RNA. The top strand is the sense strand, and the bottom strand is the antisense strand. In a further related embodiment, the DsiRNA comprises:

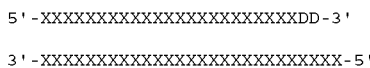

wherein "X"=RNA, "X"=2'-O-methyl RNA, and "D"=DNA. The top strand is the sense strand, and the bottom strand is the antisense strand. This modification pattern is also referred to herein as the "AS-M46" or "M46" modification pattern.

In further embodiments, the DsiRNA comprises:

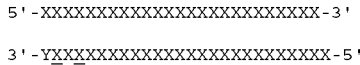

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

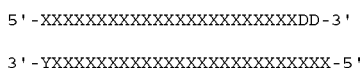

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

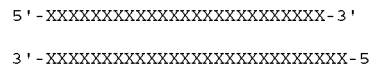

wherein "X"=RNA and "X"=2'-O-methyl RNA. The top strand is the sense strand, and the bottom strand is the antisense strand. In a further related embodiment, the DsiRNA comprises:

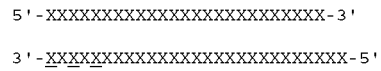

wherein "X"=RNA, "X"=2'-O-methyl RNA, and "D"=DNA. The top strand is the sense strand, and the bottom strand is the antisense strand. This modification pattern is also referred to herein as the "AS-M47" or "M47" modification pattern.

In additional embodiments, the DsiRNA comprises:

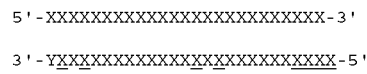

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

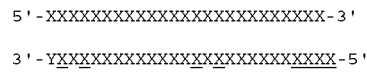

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

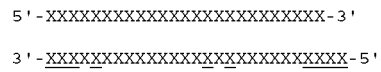

wherein "X"=RNA and "X"=2'-O-methyl RNA. The top strand is the sense strand, and the bottom strand is the antisense strand. In a further related embodiment, the DsiRNA comprises:

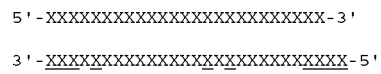

wherein "X"=RNA, "X"=2'-O-methyl RNA, and "D"=DNA. The top strand is the sense strand, and the bottom strand is the antisense strand. This modification pattern is also referred to herein as the "AS-M48" or "M48" modification pattern.

In further embodiments, the DsiRNA comprises:

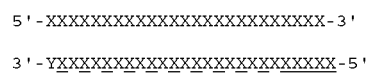

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M52" or "M52" modification pattern.

In further embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M54" or "M54" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXDD-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M55" or "M55" modification pattern.

In further embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M56" or "M56" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M57" or "M57" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M58" or "M58" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M59" or "M59" modification pattern.

In further embodiments, the DsiRNA comprises,

```
5'-XXXXXXXXXXXXXXXXXXXXXXX-3'
3'-YXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M60" or "M60" modification pattern.

In additional embodiments, the DsiRNA comprises:

```
5'-XXXXXXXXXXXXXXXXXXXXXXX-3'
3'-YXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M61" or "M61" modification pattern.

In further embodiments, the DsiRNA comprises:

```
5'-XXXXXXXXXXXXXXXXXXXXXXX-3'
3'-YXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M62" or "M62" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXDD-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M63" or "M63" modification pattern.

In further embodiments, the DsiRNA comprises:

```
5'-XXXXXXXXXXXXXXXXXXXXXXXXX-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXDD-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M64" or "M64" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXDD-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

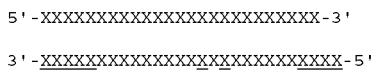

wherein "X"=RNA and "X"=2'-O-methyl RNA. The top strand is the sense strand, and the bottom strand is the antisense strand. In a further related embodiment, the DsiRNA comprises:

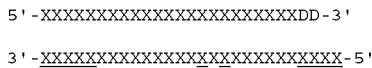

wherein "X"=RNA, "X"=2'-O-methyl RNA, and "D"=DNA. The top strand is the sense strand, and the bottom strand is the antisense strand. This modification pattern is also referred to herein as the "AS-M65" or "M65" modification pattern.

In further embodiments, the DsiRNA comprises:

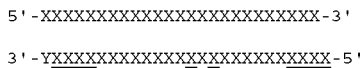

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

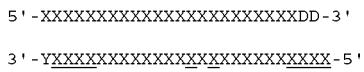

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

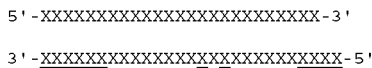

wherein "X"=RNA and "X"=2'-O-methyl RNA. The top strand is the sense strand, and the bottom strand is the antisense strand. In a further related embodiment, the DsiRNA comprises:

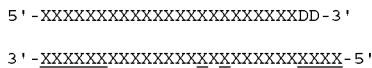

wherein "X"=RNA, "X"=2'-O-methyl RNA, and "D"=DNA. The top strand is the sense strand, and the bottom strand is the antisense strand. This modification pattern is also referred to herein as the "AS-M66" or "M66" modification pattern.

In additional embodiments, the DsiRNA comprises:

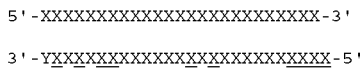

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

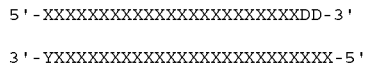

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

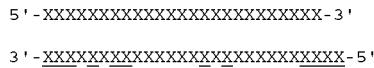

wherein "X"=RNA and "X"=2'-O-methyl RNA. The top strand is the sense strand, and the bottom strand is the antisense strand. In a further related embodiment, the DsiRNA comprises:

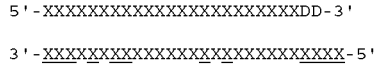

wherein "X"=RNA, "X"=2'-O-methyl RNA, and "D"=DNA. The top strand is the sense strand, and the bottom strand is the antisense strand. This modification pattern is also referred to herein as the "AS-M67" or "M67" modification pattern.

In further embodiments, the DsiRNA comprises:

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

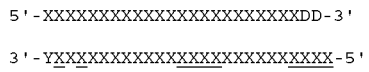

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

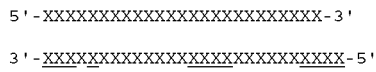

wherein "X"=RNA and "X"=2'-O-methyl RNA. The top strand is the sense strand, and the bottom strand is the antisense strand. In a further related embodiment, the DsiRNA comprises:

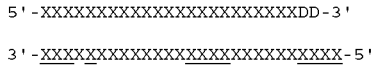

wherein "X"=RNA, "X"=2'-O-methyl RNA, and "D"=DNA. The top strand is the sense strand, and the bottom strand is the antisense strand. This modification pattern is also referred to herein as the "AS-M68" or "M68" modification pattern.

In additional embodiments, the DsiRNA comprises:

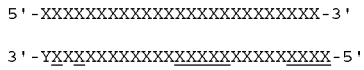

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

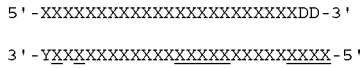

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

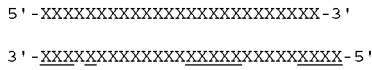

wherein "X"=RNA and "X"=2'-O-methyl RNA. The top strand is the sense strand, and the bottom strand is the antisense strand. In a further related embodiment, the DsiRNA comprises:

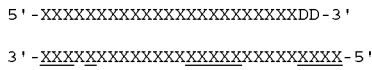

wherein "X"=RNA, "X"=2'-O-methyl RNA, and "D"=DNA. The top strand is the sense strand, and the bottom strand is the antisense strand. This modification pattern is also referred to herein as the "AS-M69" or "M69" modification pattern.

In further embodiments, the DsiRNA comprises:

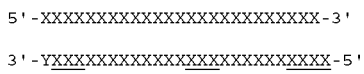

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

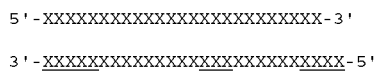

wherein "X"=RNA and "X"=2'-O-methyl RNA. The top strand is the sense strand, and the bottom strand is the antisense strand. In a further related embodiment, the DsiRNA comprises:

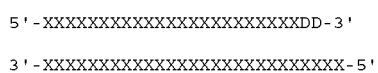

wherein "X"=RNA, "X"=2'-O-methyl RNA, and "D"=DNA. The top strand is the sense strand, and the bottom strand is the antisense strand. This modification pattern is also referred to herein as the "AS-M70" or "M70" modification pattern.

In additional embodiments, the DsiRNA comprises:

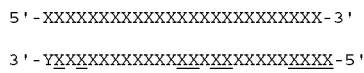

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

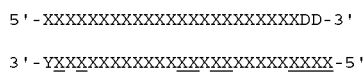

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

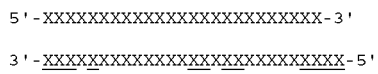

wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M71" or "M71" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M72" or "M72" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M73" or "M73" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M7*" or "M7*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M6*" or "M6*" modification pattern.

In other embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In another related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M5*" or "M5*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M4*" or "M4*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M8*" or "M8*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M2*" or "M2*" modification pattern.

In other embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M10*" or "M10*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M11*" or "M11*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M13*" or "M13*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M14*" or "M14*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M15*" or "M15*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M16*" or "M16*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M17*" or "M17*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M18*" or "M18*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M19*" or "M19*" modification pattern.

In further embodiments, the DsiRNA comprises:

```
5'-XXXXXXXXXXXXXXXXXXXXXXXXDD-3'
3'-YXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M20*" or "M20*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M22*" or "M22*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M24*" or "M24*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M25*" or "M25*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M26*" or "M26*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M27*" or "M27*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M28*" or "M28*" modification pattern.

In further embodiments, the DsiRNA comprises:

```
5'-XXXXXXXXXXXXXXXXXXXXXXXXDD-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M29*" or "M29*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M34*" or "M34*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M35*" or "M35*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M37*" or "M37*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M38*" or "M38*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M40*" or "M40*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M41*" or "M41*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M36*" or "M36*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M42*" or "M42*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M43*" or "M43*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M44*" or "M44*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M46*" or "M46*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XX̲X̲X̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M47*" or "M47*" modification pattern.

In further embodiments, the DsiRNA comprises:

```
5'-XXXXXXXXXXXXXXXXXXXXXXXXX-3'

3'-X̲X̲X̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-X̲X̲X̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M48*" or "M48*" modification pattern.

In additional embodiments, the DsiRNA comprises:

```
5'-XXXXXXXXXXXXXXXXXXXXXXXXX-3'

3'-X̲X̲X̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-X̲X̲X̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M52*" or "M52*" modification pattern. In further embodiments, the DsiRNA comprises:

```
5'-XXXXXXXXXXXXXXXXXXXXXXXXX-3'

3'-X̲X̲X̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-X̲X̲X̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M54*" or "M54*" modification pattern.

In additional embodiments, the DsiRNA comprises:

```
5'-XXXXXXXXXXXXXXXXXXXXXXXXX-3'

3'-X̲X̲X̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-X̲X̲X̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M55*" or "M55*" modification pattern.

In further embodiments, the DsiRNA comprises:

```
5'-XXXXXXXXXXXXXXXXXXXXXXXXX-3'

3'-X̲X̲X̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-X̲X̲X̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M56*" or "M56*" modification pattern.

In additional embodiments, the DsiRNA comprises:

```
5'-XXXXXXXXXXXXXXXXXXXXXXXXX-3'

3'-X̲X̲X̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-X̲X̲X̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M57*" or "M57*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M58*" or "M58*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M59*" or "M59*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M60*" or "M60*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M61*" or "M61*" modification pattern.

In further embodiments, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M62*" or "M62*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M63*" or "M63*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M64*" or "M64*" modification pattern.

In additional embodiments, the DsiRNA comprises:

```
5'-XXXXXXXXXXXXXXXXXXXXXXXXX-3'
3'-X̲XXXXXXXXXXXXXXXX̲XXXXXXXX̲X̲X̲X̲-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXX-3'
3'-X̲XXXXXXXXXXXXXXXXX̲XXXXXXX̲X̲X̲X̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M65*" or "M65*" modification pattern.

In further embodiments, the DsiRNA comprises:

```
5'-XXXXXXXXXXXXXXXXXXXXXXXXX-3'
3'-X̲XXXXXXXXXXXXXXXXX̲XXXXXX̲X̲X̲X̲X̲-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXX-3'
3'-X̲XXXXXXXXXXXXXXXXX̲XXXXX̲X̲X̲X̲X̲X̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M66*" or "M66*" modification pattern.

In additional embodiments, the DsiRNA comprises:

```
5'-XXXXXXXXXXXXXXXXXXXXXXXXX-3'
3'-X̲XXXXXXXXXXXXXXXXX̲XXXX̲X̲X̲X̲X̲X̲X̲-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXX-3'
3'-X̲XXXXXXXXXXXXXXXXX̲XXX̲X̲X̲X̲X̲X̲X̲X̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M67*" or "M67*" modification pattern.

In further embodiments, the DsiRNA comprises:

```
5'-XXXXXXXXXXXXXXXXXXXXXXXXX-3'
3'-X̲XXXXXXXXXXXXXXXXX̲XXXXXXXX̲X̲X̲X̲-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXX-3'
3'-X̲XXXXXXXXXXXXXXXXX̲XXXXXXX̲X̲X̲X̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M68*" or "M68*" modification pattern.

In additional embodiments, the DsiRNA comprises:

```
5'-XXXXXXXXXXXXXXXXXXXXXXXXX-3'
3'-X̲XXXXXXXXXXXXXXXXX̲XXXXXX̲X̲X̲X̲X̲-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-X̲XXXXXXXXXXXXXXXXX̲XXXXX̲X̲X̲X̲X̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M69*" or "M69*" modification pattern.

In further embodiments, the DsiRNA comprises:

```
5'-XXXXXXXXXXXXXXXXXXXXXXXXX-3'
3'-X̲XXXXXXXXXXXXXXXXX̲XXXX̲X̲X̲X̲X̲X̲-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-X̲XXXXXXXXXXXXXXXXX̲XXX̲X̲X̲X̲X̲X̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M70*" or "M70*" modification pattern.

In additional embodiments, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M71*" or "M71*" modification pattern.

In further embodiments, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M72*" or "M72*" modification pattern.

In additional embodiments, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M73*" or "M73*" modification pattern.

Additional exemplary antisense strand modifications include the following:

```
3'-XXXXXXXXXXXXXXXXXXXXXXXXXXX-5'     "AS-M74"

3'-XXXXXXXXXXXXXXXXXXXXXXXXXXX-5'     "AS-M75"

3'-XXXXXXXXXXXXXXXXXXXXXXXXXXX-5'     "AS-M76"

3'-XXXXXXXXXXXXXXXXXXXXXXXXXXX-5'     "AS-M77"

3'-XXXXXXXXXXXXXXXXXXXXXXXXXXX-5'     "AS-M78"

3'-XXXXXXXXXXXXXXXXXXXXXXXXXXX-5'     "AS-M79"

3'-XXXXXXXXXXXXXXXXXXXXXXXXXXX-5'     "AS-M80"

3'-XXXXXXXXXXXXXXXXXXXXXXXXXXX-5'     "AS-M81"

3'-XpXXXXXXXXXXXXXXXXXXXXXXXXXXX-5'   "AS-M82"

3'-XpXXXXXXXXXXXXXXXXXXXXXXXXXXX-5'   "AS-M83"

3'-XXXXXXXXXXXXXXXXXXXXXXXXXXX-5'     "AS-M84"

3'-XXXXXXXXXXXXXXXXXXXXXXXXXXX-5'     "AS-M85"

3'-FFFXXXXXXXXXXXXXXXXXXXXXFFFF-5'    "AS-M88"

3'-XXXXFXXXFXXXXXXXXXXXXXXXX-5'       "AS-M89"

3'-FFFXFXFXFXFXFXFXXXXXXXFFFF-5'      "AS-M90"

3'-FFFXXXXXXXXXXXXXXXXXXXXXFF-5'      "AS-M91"

3'-XXXXXFXXXXXFXFXXXXXXXXXXX-5'       "AS-M92"

3'-FFFXFXXXXXXXXXXXXFXXXXXXXX-5'      "AS-M93"

3'-FFFXFXFXXXXXFXFXFXXXXXFFFF-5'      "AS-M94"

3'-FFFXFXFXFXFXFXFXXXXXXXFFFF-5'      "AS-M95"

3'-FFFXFXFXFXFXFXFXXXXXXXFFFpF-5'     "AS-M96"

3'-XXXXXXXXXXXXXXXXXXXXXXXXXXX-5'     "AS-M210"

3'-XXXXXXXXXXXXXXXXXXXXXXXXXXX-5'     "AS-M74*"

3'-XXXXXXXXXXXXXXXXXXXXXXXXXXX-5'     "AS-M75*"

3'-XXXXXXXXXXXXXXXXXXXXXXXXXXX-5'     "AS-M76*"

3'-XXXXXXXXXXXXXXXXXXXXXXXXXXX-5'     "AS-M77*"

3'-XXXXXXXXXXXXXXXXXXXXXXXXXXX-5'     "AS-M78*"

3'-XXXXXXXXXXXXXXXXXXXXXXXXXXX-5'     "AS-M79*"

3'-XXXXXXXXXXXXXXXXXXXXXXXXXXX-5'     "AS-M80*"

3'-XpXXXXXXXXXXXXXXXXXXXXXXXXXXX-5'   "AS-M82*"

3'-XpXXXXXXXXXXXXXXXXXXXXXXXXXXX-5'   "AS-M83*"

3'-XXXXXXXXXXXXXXXXXXXXXXXXXXX-5'     "AS-M84*"

3'-XFFXXXXXXXXXXXXXXXXXXXFFFF-5'      "AS-M88*"

3'-XXXXFXXXFXFXXXXXXXXXXXXXX-5'       "AS-M89*"

3'-XFFXFXFXFXFXFXFXXXXXXXFFFF-5'      "AS-M90*"

3'-XFFXXXXXXXXXXXXXXXXXXXXXFF-5'      "AS-M91*"

3'-XXXXXFXXXXXFXFXXXXXXXXXXX-5'       "AS-M92*"

3'-XFFXFXXXXXXXXXXXXFXXXXXXXX-5'      "AS-M93*"

3'-XFFXFXFXXXXXFXFXFXXXXXFFFF-5'      "AS-M94*"

3'-XFFXFXFXFXFXFXFXXXXXXXFFFF-5'      "AS-M95*"

3'-XFFXFXFXFXFXFXFXXXXXXXFFFpF-5'     "AS-M96*"

3'-XXXXXXXXXXXXXXXXXXXXXXXXXXX-5'     "AS-M210*"
```

3'-XpXXXXXXXXXXXXXXXXXXXXXXXXXXpX-5'  "AS-M101"
3'-XpXXXXXXXXXXXXXXXXXXXXXXXXXXpX-5'  "AS-M104"
3'-XpXXXXXXXXXXXXXXXXXXXXXXXXXXpX-5'  "AS-M104*"
3'-XpFpXFXFXFXFXFXFXFXFXFFXXXpX-5'  "AS-M105"
3'-XpFpXFXFXFXFXFXFXFXFXFFXXXpX-5'  "AS-M105*"
3'-XpXXXXXXXXXXXXXXXXXXXXXXXXXXpX-5'  "AS-M106"
3'-XpXXXXXXXXXXXXXXXXXXXXXXXXXXpX-5'  "AS-M106*"
3'-XXpXXXXXXXXXXXXXXXXXXXXXXXX-5'  "AS-M107"
3'-XXpXXXXXXXXXXXXXXXXXXXXXXXX-5'  "AS-M107*"
3'-ba-XXXXXXXXXXXXXXXXXXXXXXXXXX-5'  "AS-M108"
(ba = inverted abasic for F7 stabilization at 3' end)
3'-ba-XXXXXXXXXXXXXXXXXXXXXXXXXX-5'  "AS-M108*"
(ba = inverted abasic for F7 stabilization at 3' end)
3'-XDXXXXXXXXXXXXXXXXXXXXXXXXXX-5'  "AS-M109"
3'-XpXXFXFXFXXXXXXXXXXXXXXXXXpX-5'  "AS-M110"
3'-XpXXFXFXFXXXXXXXXXXXXXXXXXpX-5'  "AS-M110*"
3'-XpXXFXFXFXXXXXXXXFXFXFXXXXpX-5'  "AS-M111"
3'-XpXXFXFXFFXXXXXXXXXFXXXXXpX-5'  "AS-M112"
3'-XpXXFXFXFFXXFXXXXXFXXXXXpX-5'  "AS-M113"
3'-XpXXFXFXFFFFFXXXXXXXFXXXXXpX-5'  "AS-M114"
3'-XpXXFXFXFFFFFXXXXXXXFXXFXXXpX-5'  "AS-M115"
3'-XpXXFXFXFFFFFXXXXXXXFFFFXXXpX-5'  "AS-M116"
3'-XpFXFXFXFXFXFXFXFXFXFXFpX-5'  "AS-M117"
3'-XpXXFXFXFXXXXXFXFXFXXXXXXpX-5'  "AS-M111*"
3'-XpXXFXFXFFXXXXXXXXXFXXXXXpX-5'  "AS-M112*"
3'-XpXXFXFXFFXXFXXXXXFXXXXXpX-5'  "AS-M113*"
3'-XpXXFXFXFFFFFXXXXXXXFXXXXXpX-5'  "AS-M114*"
3'-XpXXFXFXFFFFFXXXXXXXFXXFXXXpX-5'  "AS-M115*"
3'-XpXXFXFXFFFFFXXXXXXXFFFFXXXpX-5'  "AS-M116*"
3'-XpFXFXFXFXFXFXFXFXFXFXFpX-5'  "AS-M117*"
3'-XpXXXXXXXXXXXXXXXXXXXXXXXXXXpX-5'  "AS-M120"
3'-XpXXXXXXXXXXXXXXXXXXXXXXXXXXpX-5'  "AS-M121"
3'-XpXXXXXXXXXXXXXXXXXXXXXXXXXXpX-5'  "AS-M122"
3'-XpXXXXXXXXXXXXXXXXXXXXXXXXXXpX-5'  "AS-M123"
3'-XpXXXXXXXXXXXXXXXXXXXXXXXXXXpX-5'  "AS-M124"
3'-XpXXXXXXXXXXXXXXXXXXXXXXXXXXpX-5'  "AS-M125"
3'-XpFpXFXFXFXXXXXFXFXFXXXXFXFpX-5'  "AS-M126"
3'-XpFpXFXFXFXFXXXXXFXFXXXXFXFpX-5'  "AS-M127"
3'-XpFpXFXFXFXFXFXFXFXFXFFXXXpX-5'  "AS-M128"
3'-XpFpXFXFXFXFXFXFXFXFXFFFFFpF-5'  "AS-M129"

3'-XpFpXFXFXFXFXFXFXFXFFXXXFXFpX-5'  "AS-M130"
3'-XpFpXFXFXFXFXFXFXFXFXFXFpX-5'  "AS-M131"
3'-XpFpXFXFXFXFXFXFXFXFXFXXXXpX-5'  "AS-M132"
3'-XpFpXFXFXFXFXFXFXFXFXFXXXXpX-5'  "AS-M133"
3'-XpFpXFXFXFXFXFXFXFXFXFFFpF-5'  "AS-M134"
3'-XXXXXXXXXXXXXXXXXXXXXXXXXXXX-5'  "AS-M135"
3'-XXXXXXXXXXXXXXXXXXXXXXXXXXXX-5'  "AS-M136"
3'-XXXXXXXXXXXXXXXXXXXXXXXXXXXX-5'  "AS-M137"
3'-XXXFXFXFXXXXXFXFXFXXXXXXX-5'  "AS-M138"
3'-XXXFXFFXXXXXXXXXFXXXXXXX-5'  "AS-M139"
3'-XpXXFXFXFXXXXXFXFFFXXXXXXpX-5'  "AS-M140"
3'-XpXXFXFFXXXXFFXFFFFXXXXXXpX-5'  "AS-M141"
3'-XpXXFXFXFXFXFXFFFXXXXXXpX-5'  "AS-M142"
3'-XpXXFXFFFFFFFFXFFFXXXXXXpX-5'  "AS-M143"
3'-XpXXFXFXFXFXFXFXFpXpFpXXXXXXpX-5'  "AS-M144"
3'-XXXXXXXXXXXXXXXFXXXXXXXXXX-5'  "AS-M145"
3'-XXXXXXXXXXXXXXXFXXXXXXXXXX-5'  "AS-M146"
3'-XXXXXXXFXXXXXXXXXXXXXXXXXX-5'  "AS-M147"
3'-XXXXXXXXXXFXXXXXXXXXXXXXX-5'  "AS-M148"
3'-XXXXXXXXXFXXXXXXXXXXXXXXXX-5'  "AS-M149"
3'-XXXXXXXXXXFXFXXXXXXXXXXXXX-5'  "AS-M150"
3'-XXXXXXXXXXFXXXFXXXXXXXXX-5'  "AS-M151"
3'-XXXXXXXXXXFXXXFXXXXXXXXX-5'  "AS-M152"
3'-XXXXXXXXXXFXXXXXXXXXXXXXX-5'  "AS-M153"
3'-XXXXXXXXXXFXXXXXXXXXXXXXX-5'  "AS-M154"
3'-XXXXXXXFXXXXXXXXXXXXXXXX-5'  "AS-M155"
3'-XpXXXXXXXXXXXXXXXXXXXXXXXXpX-5'  "AS-M156"
3'-XpXXXXXXXXXXXXXXXXXXXXXXXXpX-5'  "AS-M157"
3'-XpXXFXFFFFXXXFXXFXXFXXXXXXpX-5'  "AS-M158"
3'-XpXXFXFFFFFFFFXXFXXFFXXXXXpX-5'  "AS-M159"
3'-XpXXFXXXFXXXXXFXFXXFXXXXXXpX-5'  "AS-M160"
3'-XpXXFXXXFXFXFXFXFXFFXXXXXXpX-5'  "AS-M161"
3'-XXXXXXXXFXFXFXXXXXXXXXXXXX-5'  "AS-M162"
3'-XXXXXXXXXXXXXXXXXXXXXXXXXXXX-5'  "AS-M163"
3'-XXXXXXXXDXXXXXXXXXXXXXXXXX-5'  "AS-M164"
3'-XpXXXXXXXXXXXXXXXXXXXXXXXXXXpX-5'  "AS-M120*"
3'-XpXXXXXXXXXXXXXXXXXXXXXXXXXXpX-5'  "AS-M121*"
3'-XpXXXXXXXXXXXXXXXXXXXXXXXXXXpX-5'  "AS-M122*"
3'-XpXXXXXXXXXXXXXXXXXXXXXXXXXXpX-5'  "AS-M123*"
3'-XpXXXXXXXXXXXXXXXXXXXXXXXXXXpX-5'  "AS-M124*"
3'-XpXXXXXXXXXXXXXXXXXXXXXXXXXXpX-5'  "AS-M125*"

-continued

| Sequence | Name |
|---|---|
| 3'-XpFpXFXFXFXXXXXFXFXFXFXXXFXFpX-5' | "AS-M126*" |
| 3'-XpFpXFXFXFXXXXXFXFXFXFXXXFXFpX-5' | "AS-M127*" |
| 3'-XpFpXFXFXFXFXFXFXFXFXFXFFXXXpX-5' | "AS-M128*" |
| 3'-XpFpXFXFXFXFXFXFXFXFXFXFFFFFpF-5' | "AS-M129*" |
| 3'-XpFpXFXFXFXFXFXFXFXFXXXFXFpX-5' | "AS-M130*" |
| 3'-XpFpXFXFXFXFXFXFXFXFXFXFXFpX-5' | "AS-M131*" |
| 3'-XpFpXFXFXFXFXFXFXFXFXFXXXXpX-5' | "AS-M132*" |
| 3'-XpFpXFXFXFXFXFXFXFXFXFXXXXpX-5' | "AS-M133*" |
| 3'-XpFpXFXFXFXFXFXFXFXFXFXFFFpF-5' | "AS-M134*" |
| 3'-XXXXXXXXXXXXXXXXXXXXXXXXXXX-5' | "AS-M135*" |
| 3'-XXXXXXXXXXXXXXXXXXXXXXXXXXX-5' | "AS-M136*" |
| 3'-XXXXXXXXXXXXXXXXXXXXXXXXXXX-5' | "AS-M137*" |
| 3'-XXXFXFXFXXXXXFXFXFXFXXXXXX-5' | "AS-M138*" |
| 3'-XXXFXFFXXXXXXXXXFXXXXXXX-5' | "AS-M139*" |
| 3'-XpXXFXFXFXXXXXFXFFFXXXXXXXpX-5' | "AS-M140*" |
| 3'-XpXXFXFXFFXXXFFXFXFFFXXXXXXpX-5' | "AS-M141*" |
| 3'-XpXXFXFXFXFXFXFXFFFFXXXXXXpX-5' | "AS-M142*" |
| 3'-XpXXFXFXFFFFFFFXFXFFFXXXXXXpX-5' | "AS-M143*" |
| 3'-XpXXFXFXFXFXFXFXFFpXpFpXXXXXXpX-5' | "AS-M144*" |
| 3'-XXXXXXXXXXXXXXXXFXXXXXXXXXX-5' | "AS-M145*" |
| 3'-XXXXXXXXXXXXXXFXXXXXXXXXXX-5' | "AS-M146*" |
| 3'-XXXXXXFXXXXXXXXXXXXXXXXXXX-5' | "AS-M147*" |
| 3'-XXXXXXXXXXFXXXXXXXXXXXXXXX-5' | "AS-M148*" |
| 3'-XXXXXXXXXFXXXXXXXXXXXXXXXX-5' | "AS-M149*" |
| 3'-XXXXXXXXFXFXXXXXXXXXXXXXXX-5' | "AS-M150*" |
| 3'-XXXXXXXXXXFXXXFXXXXXXXXXXX-5' | "AS-M151*" |
| 3'-XXXXXXXXXXFXXXFXXXXXXXXXXX-5' | "AS-M152*" |
| 3'-XXXXXXXXFXXXXXXXXXXXXXXXX-5' | "AS-M153*" |
| 3'-XXXXXXXXFXXXXXXXXXXXXXXXX-5' | "AS-M154*" |
| 3'-XXXXXXFXXXXXXXXXXXXXXXX-5' | "AS-M155*" |
| 3'-XpXXXXXXXXXXXXXXXXXXXXXXXXpX-5' | "AS-M156*" |
| 3'-XpXXXXXXXXXXXXXXXXXXXXXXXXpX-5' | "AS-M157*" |
| 3'-XpXXFXFFFFXXXXXXFXXFXFFXXXXXXpX-5' | "AS-M158*" |
| 3'-XpXXFXFFFFFFFFXXFXXFFXXXXXXpX-5' | "AS-M159*" |
| 3'-XpXXFXXXFXXXXXFXFXXFFXXXXXXpX-5' | "AS-M160*" |
| 3'-XpXXFXFXFXFXFXFXXFFFXXXXXXpX-5' | "AS-M161*" |
| 3'-XXXXXXXXFXFXFXXXXXXXXXXXXX-5' | "AS-M162*" |
| 3'-XXXXXXXXXXXXXXXXXXXXXXXXXXX-5' | "AS-M163*" |
| 3'-XXXXXXXXDXXXXXXXXXXXXXXXXX-5' | "AS-M164*" |
| 3'-XXXXXXXXXXXXXXXXXXXXXXXXXXX-5' | "AS-M211" |

-continued

| Sequence | Name |
|---|---|
| 3'-XXXXXXXXXXXXXXXXXXXXXXXXXXX-5' | "AS-M212" |
| 3'-XXXXXXXXXXXXXXXXXXXXXXXXXXX-5' | "AS-M215" |
| 3'-XXXXXXXXXXXXXXXXXXXXXXXXXXX-5' | "AS-M216" |
| 3'-XXXXXXXXXXXXXXXXXXXXXXXXXXX-5' | "AS-M217" |
| 3'-XXXXXXXXXXXXXXXXXXXXXXXXXXX-5' | "AS-M218" |
| 3'-XXXXXXXXXXXXXXXXXXXXXXXXXXX-5' | "AS-M219" |
| 3'-XXXXXXXXXXXXXXXXXXXXXXXXXXX-5' | "AS-M220" |
| 3'-XXXXXXXXXXXXXXXXXXXXXXXXXXX-5' | "AS-M221" |
| 3'-XXXXXXXXXXXXXXXXXXXXXXXXXXX-5' | "AS-M222" |
| 3'-XXXXXXXXXXXXXXXXXXXXXXXXXXX-5' | "AS-M223" |
| 3'-XXXXXXXXXXXXXXXXXXXXXXXXXXX-5' | "AS-M224" |
| 3'-XXXXXXXXXXXXXXXXXXXXXXXXXXX-5' | "AS-M225" |
| 3'-XXXXXXXXXXXXXXXXXXXXXXXXXXX-5' | "AS-M226" |
| 3'-XXXXXXXXXXXXXXXXXXXXXXXXXXX-5' | "AS-M230" |
| 3'-XXXXXXXXXXXXXXXXXXXXXXXXXXX-5' | "AS-M231" |
| 3'-XXXXXXXXXXXXXXXXXXXXXXXXXXX-5' | "AS-M232" |
| 3'-XXXXXXXXXXXXXXXXXXXXXXXXXXX-5' | "AS-M233" |
| 3'-XXXXXXXXXXXXXXXXXXXXXXXXXXX-5' | "AS-M234" |
| 3'-XXXXXXXXXXXXXXXXXXXXXXXXXXX-5' | "AS-M235" |
| 3'-XXXXXXXXXXXXXXXXXXXXXXXXXXX-5' | "AS-M236" |
| 3'-XXXXXXXXXXXXXXXXXXXXXXXXXXX-5' | "AS-M237" |
| 3'-XXXXXXXXXXXXXXXXXXXXXXXXXXX-5' | "AS-M238" |
| 3'-XXXXXXXXXXXXXXXXXXXXXXXXXXX-5' | "AS-M239" |
| 3'-XXXXXXXXXXXXXXXXXXXXXXXXXXX-5' | "AS-M240" |
| 3'-XXXXXXXXXXXXXXXXXXXXXXXXXXX-5' | "AS-M241" |
| 3'-XXXXXXXXXXXXXXXXXXXXXXXXXXX-5' | "AS-M242" |
| 3'-XpXXXXXXXXXXXXXXXXXXXXXXXXXpX-5' | "AS-M243" |
| 3'-XpXXXXXXXXXXXXXXXXXXXXXXXXXpX-5' | "AS-M244" |
| 3'-XpXXXXXXXXXXXXXXXXXXXXXXXXXpX-5' | "AS-M245" |
| 3'-XpXXXXXXXXXXXXXXXXXXXXXXXXXpX-5' | "AS-M246" |
| 3'-XpXXXXXXXXXXXXXXXXXXXXXXXXXpX-5' | "AS-M247" |
| 3'-XpXXXXXXXXXXXXXXXXXXXXXXXXXpX-5' | "AS-M248" |
| 3'-XpXXXXXXXXXXXXXXXXXXXXXXXXXpX-5' | "AS-M249" |
| 3'-XpXXXXXXXXXXXXXXXXXXXXXXXXXpX-5' | "AS-M250" |
| 3'-XpXXXXXXXXXXXXXXXXXXXXXXXXXpX-5' | "AS-M251" |
| 3'-XpXXXXXXXXXXXXXXXXXXXXXXXXXpX-5' | "AS-M252" |
| 3'-XpXXXXXXXXXXXXXXXXXXXXXXXXXpX-5' | "AS-M253" |
| 3'-XpXXXXXXXXXXXXXXXXXXXXXXXXXpX-5' | "AS-M254" |
| 3'-XpXXXXXXXXXXXXXXXXXXXXXXXXXpX-5' | "AS-M255" |
| 3'-XXXXXXXXXXXXXXXXXXXXXXXXXXX-5' | "AS-M527" |
| 3'-XXXXXXXXXXXXXXXXXXXXXXXXXXX-5' | "AS-M528" |

-continued

```
3'-XXXXXXXXXXXXXXXXXXXXXXXXX-5'        "AS-M529"
3'-XXXXXXXXXXXXXXXXXXXXXXXXX-5'        "AS-M211*"
3'-XXXXXXXXXXXXXXXXXXXXXXXXX-5'        "AS-M212*"
3'-XXXXXXXXXXXXXXXXXXXXXXXXX-5'        "AS-M215*"
3'-XXXXXXXXXXXXXXXXXXXXXXXXX-5'        "AS-M216*"
3'-XXXXXXXXXXXXXXXXXXXXXXXXX-5'        "AS-M217*"
3'-XXXXXXXXXXXXXXXXXXXXXXXXX-5'        "AS-M218*"
3'-XXXXXXXXXXXXXXXXXXXXXXXXX-5'        "AS-M219*"
3'-XXXXXXXXXXXXXXXXXXXXXXXXX-5'        "AS-M220*"
3'-XXXXXXXXXXXXXXXXXXXXXXXXX-5'        "AS-M221*"
3'-XXXXXXXXXXXXXXXXXXXXXXXXX-5'        "AS-M222*"
3'-XXXXXXXXXXXXXXXXXXXXXXXXX-5'        "AS-M223*"
3'-XXXXXXXXXXXXXXXXXXXXXXXXX-5'        "AS-M224*"
3'-XXXXXXXXXXXXXXXXXXXXXXXXX-5'        "AS-M225*"
3'-XXXXXXXXXXXXXXXXXXXXXXXXX-5'        "AS-M226*"
3'-XXXXXXXXXXXXXXXXXXXXXXXXX-5'        "AS-M230*"
3'-XXXXXXXXXXXXXXXXXXXXXXXXX-5'        "AS-M231*"
3'-XXXXXXXXXXXXXXXXXXXXXXXXX-5'        "AS-M232*"
3'-XXXXXXXXXXXXXXXXXXXXXXXXX-5'        "AS-M233*"
3'-XXXXXXXXXXXXXXXXXXXXXXXXX-5'        "AS-M234*"
3'-XXXXXXXXXXXXXXXXXXXXXXXXX-5'        "AS-M235*"
3'-XXXXXXXXXXXXXXXXXXXXXXXXX-5'        "AS-M236*"
3'-XXXXXXXXXXXXXXXXXXXXXXXXX-5'        "AS-M237*"
3'-XXXXXXXXXXXXXXXXXXXXXXXXX-5'        "AS-M238*"
3'-XXXXXXXXXXXXXXXXXXXXXXXXX-5'        "AS-M239*"
3'-XXXXXXXXXXXXXXXXXXXXXXXXX-5'        "AS-M240*"
3'-XXXXXXXXXXXXXXXXXXXXXXXXX-5'        "AS-M241*"
3'-XXXXXXXXXXXXXXXXXXXXXXXXX-5'        "AS-M242*"
3'-XpXXXXXXXXXXXXXXXXXXXXXXXXXpX-5'    "AS-M243*"
3'-XpXXXXXXXXXXXXXXXXXXXXXXXXXpX-5'    "AS-M244*"
3'-XpXXXXXXXXXXXXXXXXXXXXXXXXXpX-5'    "AS-M245*"
3'-XpXXXXXXXXXXXXXXXXXXXXXXXXXpX-5'    "AS-M246*"
3'-XpXXXXXXXXXXXXXXXXXXXXXXXXXpX-5'    "AS-M247*"
3'-XpXXXXXXXXXXXXXXXXXXXXXXXXXpX-5'    "AS-M248*"
3'-XpXXXXXXXXXXXXXXXXXXXXXXXXXpX-5'    "AS-M249*"
3'-XpXXXXXXXXXXXXXXXXXXXXXXXXXpX-5'    "AS-M250*"
3'-XpXXXXXXXXXXXXXXXXXXXXXXXXXpX-5'    "AS-M251*"
3'-XpXXXXXXXXXXXXXXXXXXXXXXXXXpX-5'    "AS-M252*"
3'-XpXXXXXXXXXXXXXXXXXXXXXXXXXpX-5'    "AS-M253*"
3'-XpXXXXXXXXXXXXXXXXXXXXXXXXXpX-5'    "AS-M254*"
3'-XpXXXXXXXXXXXXXXXXXXXXXXXXXpX-5'    "AS-M255*"
3'-XXXXXXXXXXXXXXXXXXXXXXXXX-5'        "AS-M527*"
3'-XXXXXXXXXXXXXXXXXXXXXXXXX-5'        "AS-M528*"
3'-XXXXXXXXXXXXXXXXXXXXXXXXX-5'        "AS-M529*"
``` where "X"=RNA, "X"=2'-O-methyl RNA, "D"=DNA, "F"=2'-Fluoro NA and "p"=Phosphorothioate linkage.

In certain additional embodiments, the antisense strand of selected dsRNAs of the invention are extended, optionally at the 5' end, with an exemplary 5' extension of base "AS-M8", "AS-M17" and "AS-M48" modification patterns respectively represented as follows:

```
                                        (SEQ ID NO: 3534)
3'-XXXXXXXXXXXXXXXXXXXXXXXXXXXUAGCUAUCGT-5'  "AS-M8,
extended"

(SEQ ID NO: 3534)
3'-XXXXXXXXXXXXXXXXXXXXXXXXXXXUAGCUAUCGT-5'  "AS-
M17,
extended"

(SEQ ID NO: 3534)
3'-XXXXXXXXXXXXXXXXXXXXXXXXXXXUAGCUAUCGT-5'  "AS-
M48,
extended"
``` where "X"=RNA; "X"=2'-O-methyl RNA; "F"=2'-Fluoro NA and "A" in bold, italics indicates a 2'-Fluoro-adenine residue.

In certain embodiments, the sense strand of a DsiRNA of the invention is modified—specific exemplary forms of sense strand modifications are shown below, and it is contemplated that such modified sense strands can be substituted for the sense strand of any of the DsiRNAs shown above to generate a DsiRNA comprising a below-depicted sense strand that anneals with an above-depicted antisense strand. Exemplary sense strand modification patterns include:

```
5'-XXXXXXXXXXXXXXXXXXXXXXXXDD-3'       "SM1"
5'-XXXXXXXXXXXXXXXXXXXXXXXXDD-3'       "SM2"
5'-XXXXXXXXXXXXXXXXXXXXXXXXDD-3'       "SM3"
5'-XXXXXXXXXXXXXXXXXXXXXXXXDD-3'       "SM4"
5'-XXXXXXXXXXXXXXXXXXXXXXXXDD-3'       "SM5"
5'-XXXXXXXXXXXXXXXXXXXXXXXXDD-3'       "SM6"
5'-XXXXXXXXXXXXXXXXXXXXXXXXDD-3'       "SM7"
5'-XXXXXXXXXXXXXXXXXXXXXXXXDD-3'       "SM8"
5'-XXXXXXXXXXXXXXXXXXXXXXXXDD-3'       "SM9"
5'-XXXXXXXXXXXXXXXXXXXXXXXXDD-3'       "SM10"
5'-XXXXXXXXXXXXXXXXXXXXXXXXDD-3'       "SM11"
5'-XXXXXXXXXXXXXXXXXXXXXXXXDD-3'       "SM12"
5'-XXXXXXXXXXXXXXXXXXXXXXXXDD-3'       "SM13"
5'-XXXXXXXXXXXXXXXXXXXXXXXXDD-3'       "SM14"
5'-XXXXXXXXXXXXXXXXXXXXXXXXDD-3'       "SM15"
5'-XXXXXXXXXXXXXXXXXXXXXXXXDD-3'       "SM16"
```

-continued

| | |
|---|---|
| 5'-XXXXXXXXXXXXXXXXXXXXXXDD-3' | "SM17" |
| 5'-XXXXXXXXXXXXXXXXXXXXXXDD-3' | "SM18" |
| 5'-XXXXXXXXXXXXXXXXXXXXXXDD-3' | "SM19" |
| 5'-XXXXXXXXXXXXXXXXXXXXXXDD-3' | "SM20" |
| 5'-XXXXXXXXXXXXXXXXXXXXXXDD-3' | "SM21" |
| 5'-XXXXXXXXXXXXXXXXXXXXXXDD-3' | "SM23" |
| 5'-XXXXXXXXXXXXXXXXXXXXXXDD-3' | "SM24" |
| 5'-XXXXXXXXXXXXXXXXXXXXXXDD-3' | "SM25" |
| 5'-XXXXXXXXXXXXXXXXXXXXXXDD-3' | "SM30" |
| 5'-XXXXXXXXXXXXXXXXXXXXXXDD-3' | "SM31" |
| 5'-XXXXXXXXXXXXXXXXXXXXXXDD-3' | "SM32" |
| 5'-XXXXXXXXXXXXXXXXXXXXXXDD-3' | "SM33" |
| 5'-XXXXXXXXXXXXXXXXXXXXXXDD-3' | "SM34" |
| 5'-XXXXXXXXXXXXXXXXXXXXXXDD-3' | "SM35" |
| 5'-XXXXXXXXXXXXXXXXXXXXXXDD-3' | "SM36" |
| 5'-XXXXXXXXXXXXXXXXXXXXXXDD-3' | "SM37" |
| 5'-XXXXXXXXXXXXXXXXXXXXXXDD-3' | "SM38" |
| 5'-XXXXXXXXXXXXXXXXXXXXXXDD-3' | "SM39" |
| 5'-XXXXXXXXXXXXXXXXXXXXXXDD-3' | "SM40" |
| 5'-XXXXXXXXXXXXXXXXXXXXXXDD-3' | "SM41" |
| 5'-XXXXXXXXXXXXXXXXXXXXXXDD-3' | "SM42" |
| 5'-XXXXXXXXXXXXXXXXXXXXXXDD-3' | "SM43" |
| 5'-XXXXXXXXXXXXXXXXXXXXXXDD-3' | "SM44" |
| 5'-XXXXXXXXXXXXXXXXXXXXXXDD-3' | "SM45", "SM47" |
| 5'-XXXXXXXXXXXXXXXXXXXXXXDD-3' | "SM46" |
| 5'-XXXXXXXXXXXXXXXXXXXXXXDD-3' | "SM48" |
| 5'-XXXXXXXXXXXXXXXXXXXXXXDD-3' | "SM49" |
| 5'-XXXXXXXXXXXXXXXXXXXXXXDD-3' | "SM50" |
| 5'-XXXXXXXXXXXXXXXXXXXXXXDD-3' | "SM51" |
| 5'-XXXXXXXXXXXXXXXXXXXXXXDD-3' | "SM52" |
| 5'-XXXXXXXXXXXXXXXXXXXXXXDD-3' | "SM53" |
| 5'-XXXXXXXXXXXXXXXXXXXXXXDD-3' | "SM54" |
| 5'-XXXXXXXXXXXXXXXXXXXXXXDD-3' | "SM55" |
| 5'-XXXXXXXXXXXXXXXXXXXXXXDD-3' | "SM56" |
| 5'-XXXXXXXXXXXXXXXXXXXXXXDD-3' | "SM57" |
| 5'-XXXXXXXXXXXXXXXXXXXXXXDD-3' | "SM58" |
| 5'-XXXXXXXXXXXXXXXXXXXXXXDD-3' | "SM59" |
| 5'-XXXXXXXXXXXXXXXXXXXXXXDD-3' | "SM60" |
| 5'-XXXXXXXXXXXXXXXXXXXXXXDD-3' | "SM61" |
| 5'-XXXXXXXXXXXXXXXXXXXXXXDD-3' | "SM62" |

-continued

| | |
|---|---|
| 5'-XXXXXXXXXXXXXXXXXXXXXXDD-3' | "SM63" |
| 5'-XXXXXXXXXXXXXXXXXXXXXXDD-3' | "SM64" |
| 5'-XXXXXXXXXXXXXXXXXXXXXXDD-3' | "SM65" |
| 5'-XXXXXXXXXXXXXXXXXXXXXXpDpD-3' | "SM66" |
| 5'-XpXXXXXXXXXXXXXXXXXXXXXDD-3' | "SM67" |
| 5'-XpXXXXXXXXXXXXXXXXXXXXXpDpD-3' | "SM68" |
| 5'-DXXXXXXXXXXXXXXXXXXXXXXDD-3' | "SM69" |
| 5'-DpXXXXXXXXXXXXXXXXXXXXXXpDpD-3' | "SM70" |
| 5'-DXDXXXXXXXXXXXXXXXXXXXXDD-3' | "SM71" |
| 5'-DpXDXXXXXXXXXXXXXXXXXXXXDD-3' | "SM72" |
| 5'-XXDXXXXXXXXDXXXXXXXXXXDD-3' | "SM73" |
| 5'-XpXDXXXXXXXXDXXXXXXXXXXDD-3' | "SM74" |
| 5'-DXDXXXXXXXXDXXXXXDXXXXDD-3' | "SM75" |
| 5'-DpXDXXXXXXXXDXXXXXDXXXXDD-3' | "SM76" |
| 5'-X pXpXXXXXXXXXXXXXXXXXXXXDD-3' | "SM77" |
| 5'-X pXpXXXXXXXXXXXXXXXXXXXXXpDpD-3' | "SM78" |
| 5'-D pXpDXXXXXXXXXXXXXXXXXXXXDD-3' | "SM79" |
| 5'-X pXpDXXXXXXXXDXXXXXXXXXXDD-3' | "SM80" |
| 5'-DXDXXXDXXXXXDXXXXXDXXXXDD-3' | "SM81" |
| 5'-DpXDXXXDXXXXXDXXXXXDXXXXpDpD-3' | "SM82" |
| 5' C3 spacer-XXXXXXXXXXXXXXXXXXXXXXDD-3' | "SM83" |
| 5' C3 spacer-XXDXXXXXXXXDXXXXXXXXXXDD-3' | "SM84" |
| 5' C3 spacer-XXXXXXXXXXXXXXXXXXXXXXpDpD-3' | "SM85" |
| 5'-XXXXXXXXXXXXXXXXXXXXXXX pDpD-3' | "SM86" |
| 5'-XpXXXXXXXXXXXXXXXXXXXXXXDD-3' | "SM87" |
| 5'-XpXXXXXXXXXXXXXXXXXXXXXXpDpD-3' | "SM88" |
| 5'-DXXXXXXXXXXXXXXXXXXXXXXXDD-3' | "SM89" |
| 5'-DpXXXXXXXXXXXXXXXXXXXXXXXpDpD-3' | "SM90" |
| 5'-DXDXXXXXXXXXXXXXXXXXXXXXDD-3' | "SM91" |
| 5'-DpXDXXXXXXXXXXXXXXXXXXXXXDD-3' | "SM92" |
| 5'-XXDXXXXXXXXXDXXXXXXXXXXDD-3' | "SM93" |
| 5'-XpXDXXXXXXXXDXXXXXXXXXXXDD-3' | "SM94" |
| 5'-DXDXXXXXXXXDXXXXXDXXXXDD-3' | "SM95" |
| 5'-DpXDXXXXXXXXDXXXXXDXXXXDD-3' | "SM96" |
| 5'-XpXpXXXXXXXXXXXXXXXXXXXXXDD-3' | "SM97" |
| 5'-XpXpXXXXXXXXXXXXXXXXXXXXXXpDpD-3' | "SM98" |
| 5'-DpXpDXXXXXXXXXXXXXXXXXXXXXDD-3' | "SM99" |
| 5'-XpXpDXXXXXXXXXDXXXXXXXXXXDD-3' | "SM100" |
| 5'-DXDXXXXXXXXXDXDXXXDDXXDDD-3' | "SM101" |
| 5'-DpXDXXXXDXXXXXDXXXXXDXXXXpDpD-3' | "SM102" |

-continued

| | |
|---|---|
| 5' C3 spacer-XXXXXXXXXXXXXXXXXXXXXXXDD-3' | "SM103" |
| 5' C3 spacer-XXDXXXXXXXXXDXXXXXXXXXDD-3' | "SM104" |
| 5' C3 spacer-XXXXXXXXXXXXXXXXXXXXXXXpDpD-3' | "SM105" |
| 5'-XXXXXXXXXXXXXXXXXXXXXXXXDD-3' | "SM106" |
| 5'-XXXXXXXXXXXXXXXXXXXXXXXXDD-3' | "SM107" |
| 5'-XXXXXXXXXXXXXXXXXXXXXXXXDD-3' | "SM108" |
| 5'-XFXXXXXXXXXXXXXXXFXXXXXDD-3' | "SM110" |
| 5'-XXXFXFXXXXXXXFXXXXXXXXDD-3' | "SM111" |
| 5'-XFXFXFXFXXXFXFXFXXXXXXDD-3' | "SM112" |
| 5'-XpFXFXFXFXXXFXFXFXFXXXXXXpDpD-3' | "SM113" |
| 5'-XFXXXXXXXXXXXXXXXXXXXXXDD-3' | "SM114" |
| 5'-XXXXFFXFXXXFXFXXXXXXXXDD-3' | "SM115" |
| 5'-XFXFXXXXXXXXXXXFXXXXXXDD-3' | "SM116" |
| 5'-XFXFFFXFXXXFXFXFFFXXXXXDD-3' | "SM117" |
| 5'-XFXFXFXFXXXFXFXFXXXXXXDD-3' | "SM118" |
| 5'-XpFXFXFXFXXXFXFXFXFXXXXXXpDpD-3' | "SM119" |
| 5'-XXXXXXXXXXXXXXXXXXXXXXXXDD-3' | "SM250" |
| 5'-XXXXXXXXXXXXXXXXXXXXXXXXDD-3' | "SM251" |
| 5'-XXXXXXXXXXXXXXXXXXXXXXXXDD-3' | "SM252" |
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | |

-continued

| | |
|---|---|
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | |
| 5'-XXXXXXXXXXXXXXXXXXXXXXXX-3' | "SM22" |
| 5'-XXXXXXXXXXXXXXXXXXXXXXXX-3 | |
| 5'-XXXXXXXXXXXXXXXXXXXXXXXX-3' | |
| 5'-XXXXXXXXXXXXXXXXXXXXXXXX-3' | |
| 5'-XpXXXXXXXXXXXXXXXXXXXXXXXDpD-3' | "SM120" |
| 5'-FpXFXFXFXFXFXFXFXFXFXXDpD-3' | "SM121" |
| 5'-XpXXXXXXXXXXXXXXXXXXXXXXXDpD-3' | "SM122" |
| 5'-XpXXXXXXXXXXXXXXXXXXXXXXXDpD-3' | "SM123" |
| 5'-FpXFXXXFXXXXXXXXXXXXXXXpDpD-3' | "SM124" |
| 5'-FpXFXXXFXXXXXFXFXXXXXXXXpDpD-3' | "SM125" |
| 5'-FpXFXXXFXFFFXFXFXXXXXXXXpDpD-3' | "SM126" |
| 5'-FpXFXXXFFFFXFXFXXXFXXXpDpD-3' | "SM127" |
| 5'-FpXFXXXFFFFXFXFXXXFFXXFpDpD-3' | "SM128" |
| 5'-FpXFXXXFFFFXFXFXXXFFFFpDpD-3' | "SM129" |
| 5'-FpXFXFXFXFXFXFXFXFXFXFpDpD-3' | "SM130" |

```
5'-XpXXXXXXXXXXXXXXXXXXXXXXXXpX-3'
5'-FpXFXFXFXFXFXFXFXFFXXXpX-3'
5'-XpXXXXXXXXXXXXXXXXXXXXXXXXpX-3'
5'-XpXXXXXXXXXXXXXXXXXXXXXXXXpX-3'
5'-FpXFXXXFXXXXXXXXXXXXXXpXpX-3'
5'-FpXFXXXFXXXXXFXFXXXXXXXpXpX-3'
5'-FpXFXXXFXFFFXFXFXXXXXXXpXpX-3'
5'-FpXFXXXFXFFFXFXFXXXFFXXXpXpX-3'
5'-FpXFXXXFXFFFXFXFXXXFFFXXpXpX-3'
5'-FpXFXXXFXFFFXFXFXXXFFFFpXpX-3'
5'-FpXFXFXFXFXFXFXFXFXFXFpXpX-3'
5'-XpXXXXXXXXXXXXXXXXXXXXXXXXpDpD-3'    "SM133"
5'-XpXXXXXXXXXXXXXXXXXXXXXXXXpDpD-3'    "SM134"
5'-XpXXXXXXXXXXXXXXXXXXXXXXXXpDpD-3'    "SM135"
5'-XpXXXXXXXXXXXXXXXXXXXXXXXXpDpD-3'    "SM136"
5'-XpXXXXXXXXXXXXXXXXXXXXXXXXpDpD-3'    "SM137"
5'-XpXXXXXXXXXXXXXXXXXXXXXXXXpDpD-3'    "SM138"
5'-XpXXXXXXXXXXXXXXXXXXXXXXXXpXpX-3'
5'-XpXXXXXXXXXXXXXXXXXXXXXXXXpXpX-3'
5'-XpXXXXXXXXXXXXXXXXXXXXXXXXpXpX-3'
5'-XpXXXXXXXXXXXXXXXXXXXXXXXXpXpX-3'
5'-XpXXXXXXXXXXXXXXXXXXXXXXXXpXpX-3'
5'-XpXXXXXXXXXXXXXXXXXXXXXXXXpXpX-3'
5'-XpXXXXXXXXXXXXXXXXXXXXXXXXDpD-3'     "SM140"
5'-XpXXXXXXXXXXXXXXXXXXXXXXXXDpD-3'     "SM141"
5'-XpXXXXXXXXXXXXXXXXXXXXXXXXDpD-3'     "SM142"
5'-FpXFXFXFXFXFXFXFXFXFXXXFDpD-3'       "SM143"
5'-FpXFXFXFXFXFXFXFXFXFFFFDpD-3'        "SM144"
5'-FpXFXFXFXFXFXFXFXFXFXXXXDpD-3'       "SM145"
5'-FpXFXFXFXFXFXFXFXFXFXFDpD-3'         "SM146"
5'-FXFXXXFXFFFXFXFXXXXXXXXDD-3'         "SM147"
5'-FXFXXXFXFFFXFXFXXXFFXXXDD-3'         "SM148"
5'-FXFXXXFXFFFXFXFXXXFFXFDD-3'          "SM149"
5'-FXFXXXFXFFFXFXFXXXFFFFFDD-3'         "SM150"
5'-FpXFXFXFXFFFXFXFXFXFFXXFDpD-3'       "SM151"
5'-FpXFXFXFXFFFXXFXFXFXXXXDpD-3'        "SM152"
5'-FpXFXXFFFFFXXFXFXXXXXXDpD-3'         "SM153"
5'-ab-XXFXFFFXXFFXXXFFFFXpXXXDD-3'      "SM154"
(ab = abasic for F7 stabilization at
5' end)
5'-XpXXXXXXXXXXXXXXXXXXXXXXXXpX-3'      "SM155"
5'-XpXXXXXXXXXXXXXXXXXXXXXXXXpX-3'      "SM156"
5'-FpXFXXXFFFFFFFXXXFXXFXXFXpX-3'       "SM157"
5'-XpXFXXXFFFFXFXFXFXXFXXXXpX-3'        "SM158"
5'-FpXFXXXFXFFXFXXXFXXXFXXXXXpX-3'      "SM159"
5'-FpXFXFXFFFXFXFXFXFXXXXXXX-3'         "SM160"
5'-XpXXXXXXXXXXXXXXXXXXXXXXXXpX-3'
5'-XpXXXXXXXXXXXXXXXXXXXXXXXXpX-3'
5'-XpXXXXXXXXXXXXXXXXXXXXXXXXpX-3'
5'-FpXFXFXFXFXFXFXFXFXFXXXFXpX-3'
5'-FpXFXFXFXFXFXFXFXFFFFFXpX-3'
5'-FpXFXFXFXFXFXFXFXFXFXXXXpX-3'
5'-FpXFXFXFXFXFXFXFXFXFXFXpX-3'
5'-FXFXXXFXFFFXFXFXXXXXXXXXX-3'
5'-FXFXXXFXFFFXFXFXXXFFXXXXX-3'
5'-FXFXXXFXFFFXFXFXXXFFXXFXX-3'
5'-FXFXXXFXFFFXFXFXXXFFFFFXX-3'
5'-FpXFXFXFFFXFXFXFXFFXXFXpX-3'
5'-FpXFXFXFFFXFXFXFXFXXXXXpX-3'
5'-FpXFXFXXFFFFFFXXFXFXXFXXXXpX-3'
5'-ab-XXFXXFFFXXFFXXXFFFFXpXXXXX-3'
(ab = abasic for F7 stabilization at
5' end)
5'-XpXXXXXXXXXXXXXXXXXXXXXXXXpX-3'
5'-XpXXXXXXXXXXXXXXXXXXXXXXXXpX-3'
5'-FpXFXXXFFFFFFFXXXFXXFXXFXpX-3'
5'-XpXFXFXFFFXFXFXFXXFXXXXpX-3'
5'-FpXFXXXFXFFXFXXXFXXXFXXXXXpX-3'
5'-FpXFXFXFXFFFXFXFXFXXXXXXX-3'
5'-XXXXXXXXXXXXXXXXXXXXXXXXXXDD-3'      "SM253"
5'-XXXXXXXXXXXXXXXXXXXXXXXXXXDD-3'      "SM255"
5'-XXXXXXXXXXXXXXXXXXXXXXXXXXDD-3'      "SM256"
5'-XXXXXXXXXXXXXXXXXXXXXXXXXXDD-3'      "SM257"
5'-XXXXXXXXXXXXXXXXXXXXXXXXXXDD-3'      "SM258"
5'-XXXXXXXXXXXXXXXXXXXXXXXXXXDD-3'      "SM259"
5'-XXXXXXXXXXXXXXXXXXXXXXXXXXDD-3'      "SM260"
5'-XXXXXXXXXXXXXXXXXXXXXXXXXXDD-3'      "SM261"
5'-XXXXXXXXXXXXXXXXXXXXXXXXXXDD-3'      "SM262"
5'-XXXXXXXXXXXXXXXXXXXXXXXXXXDD-3'      "SM263"
5'-XXXXXXXXXXXXXXXXXXXXXXXXXXDD-3'      "SM264"
5'-XXXXXXXXXXXXXXXXXXXXXXXXXXDD-3'      "SM265"
5'-XXXXXXXXXXXXXXXXXXXXXXXXXXDD-3'      "SM266"
5'-XXXXXXXXXXXXXXXXXXXXXXXXXXDD-3'      "SM267"
```

| | |
|---|---|
| 5'-XXXXXXXXXXXXXXXXXXXXXXXXXDD-3' | "SM268" |
| 5'-XXXXXXXXXXXXXXXXXXXXXXXXXDD-3' | "SM269" |
| 5'-XXXXXXXXXXXXXXXXXXXXXXXXXDD-3' | "SM270" |
| 5'-XXXXXXXXXXXXXXXXXXXXXXXXXDD-3' | "SM271" |
| 5'-XXXXXXXXXXXXXXXXXXXXXXXXXDD-3' | "SM275" |
| 5'-XXXXXXXXXXXXXXXXXXXXXXXXXDD-3' | "SM276" |
| 5'-XXXXXXXXXXXXXXXXXXXXXXXXXDD-3' | "SM277" |
| 5'-XXXXXXXXXXXXXXXXXXXXXXXXXDD-3' | "SM278" |
| 5'-XXXXXXXXXXXXXXXXXXXXXXXXXDD-3' | "SM279" |
| 5'-XXXXXXXXXXXXXXXXXXXXXXXXXDD-3' | "SM280" |
| 5'-XXXXXXXXXXXXXXXXXXXXXXXXXDD-3' | "SM281" |
| 5'-XXXXXXXXXXXXXXXXXXXXXXXXXDD-3' | "SM282" |
| 5'-XXXXXXXXXXXXXXXXXXXXXXXXXDD-3' | "SM283" |
| 5'-XXXXXXXXXXXXXXXXXXXXXXXXXDD-3' | "SM284" |
| 5'-XXXXXXXXXXXXXXXXXXXXXXXXXDD-3' | "SM285" |
| 5'-XXXXXXXXXXXXXXXXXXXXXXXXXDD-3' | "SM286" |
| 5'-XXXXXXXXXXXXXXXXXXXXXXXXXDD-3' | "SM287" |
| 5'-XXXXXXXXXXXXXXXXXXXXXXXXXDD-3' | "SM288" |
| 5'-XXXXXXXXXXXXXXXXXXXXXXXXXDD-3' | "SM289" |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXX-3' | |
| 5'-XXXXXXXXXXXXXXXXXXXXXXXXXDD-3' | "SM300" |
| 5'-XpXXXXXXXXXXXXXXXXXXXXXXXDpD-3' | "SM301" |
| 5'-XpXXXXXXXXXXXXXXXXXXXXXXXDpD-3' | "SM302" |
| 5'-XpXXXXXXXXXXXXXXXXXXXXXXXDpD-3' | "SM303" |
| 5'-XpXXXXXXXXXXXXXXXXXXXXXXXDpD-3' | "SM304" |
| 5'-XpXXXXXXXXXXXXXXXXXXXXXXXDpD-3' | "SM305" |
| 5'-XpXXXXXXXXXXXXXXXXXXXXXXXDpD-3' | "SM306" |
| 5'-XpXXXXXXXXXXXXXXXXXXXXXXXDpD-3' | "SM307" |
| 5'-XpXXXXXXXXXXXXXXXXXXXXXXXDpD-3' | "SM308" |
| 5'-XpXXXXXXXXXXXXXXXXXXXXXXXDpD-3' | "SM309" |
| 5'-XpXXXXXXXXXXXXXXXXXXXXXXXDpD-3' | "SM310" |
| 5'-XXXXXXXXXXXXXXXXXXXXXXXXX-3' | |
| 5'-XpXXXXXXXXXXXXXXXXXXXXXXXpX-3' | |
| 5'-XpXXXXXXXXXXXXXXXXXXXXXXXpX-3' | |
| 5'-XpXXXXXXXXXXXXXXXXXXXXXXXpX-3' | |
| 5'-XpXXXXXXXXXXXXXXXXXXXXXXXpX-3' | |
| 5'-XpXXXXXXXXXXXXXXXXXXXXXXXpX-3' | |
| 5'-XpXXXXXXXXXXXXXXXXXXXXXXXpX-3' | |
| 5'-XpXXXXXXXXXXXXXXXXXXXXXXXpX-3' | |
| 5'-XpXXXXXXXXXXXXXXXXXXXXXXXpX-3' | |
| 5'-XpXXXXXXXXXXXXXXXXXXXXXXXpX-3' | |
| 5'-XpXXXXXXXXXXXXXXXXXXXXXXXpX-3' | | where "X"=RNA, "X̲"=2'-O-methyl RNA, "D"=DNA, "F"=2'-Fluoro NA and "p"=Phosphorothioate linkage.

It is contemplated that in certain embodiments of the invention, for all 2'-O-methyl modification patterns disclosed herein, any or all sites of 2'-O-methyl modification can optionally be replaced by a 2'-Fluoro modification. The above modification patterns can also be incorporated into, e.g., the extended DsiRNA structures and mismatch and/or frayed DsiRNA structures described below.

In another embodiment, the DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary 27mer DsiRNA agent with two terminal mismatched residues is shown:

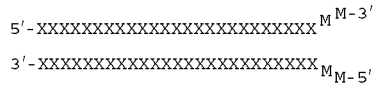

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand is the sense strand, and the bottom strand is the antisense strand. Alternatively, the bottom strand is the sense strand and the top strand is the antisense strand.

In certain additional embodiments, the present invention provides compositions for RNA interference (RNAi) that possess one or more base paired deoxyribonucleotides within a region of a double stranded ribonucleic acid (dsRNA) that is positioned 3' of a projected sense strand Dicer cleavage site and correspondingly 5' of a projected antisense strand Dicer cleavage site. The compositions of the invention comprise a dsRNA which is a precursor molecule, i.e., the dsRNA of the present invention is processed in vivo to produce an active small interfering nucleic acid (siRNA). The dsRNA is processed by Dicer to an active siRNA which is incorporated into RISC.

In certain embodiments, the DsiRNA agents of the invention can have the following exemplary structures (noting that any of the following exemplary structures can be combined, e.g., with the bottom strand modification patterns of the above-described structures—in one specific example, the bottom strand modification pattern shown in any of the above structures is applied to the 27 most 3' residues of the bottom strand of any of the following structures; in another specific example, the bottom strand modification pattern shown in any of the above structures upon the 23 most 3' residues of the bottom strand is applied to the 23 most 3' residues of the bottom strand of any of the following structures):

In one such embodiment, the DsiRNA comprises the following (an exemplary "right-extended", "DNA extended" DsiRNA):

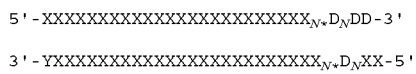

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In a related embodiment, the DsiRNA comprises:

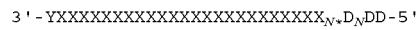

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In an additional embodiment, the DsiRNA comprises:

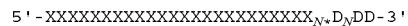

wherein "X"=RNA, "X"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

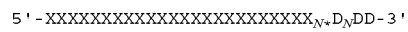

wherein "X"=RNA, "X"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

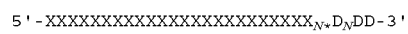
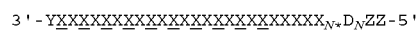

wherein "X"=RNA, "X"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DsiRNA comprises:

5'-XXXXXXXXXXXXXXXXXXXXXXXX$_{N*}$[X1/D1]$_N$DD-3'

3'-YXXXXXXXXXXXXXXXXXXXXXXXX$_{N*}$[X2/D2]$_N$ZZ-5' wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10, where at least one D1$_N$ is present in the top strand and is base paired with a corresponding D2$_N$ in the bottom strand. Optionally, D1$_N$ and D1$_{N+1}$ are base paired with corresponding D2$_N$ and D2$_{N+1}$; D1$_N$, D1$_{N+1}$ and D1$_{N+2}$ are base paired with corresponding D2$_N$, D1$_{N+1}$ and D1$_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In the structures depicted herein, the 5' end of either the sense strand or antisense strand can optionally comprise a phosphate group.

In another embodiment, a DNA:DNA-extended DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary DNA:DNA-extended DsiRNA agent with two terminal mismatched residues is shown:

5'-D$_N$XXXXXXXXXXXXXXXXXXXXXXXXXX$_{N*}$M$_{M-3'}$

3'-D$_N$XXXXXXXXXXXXXXXXXXXXXXXXXX$_{N*}$M$_{M-5'}$ wherein "X"=RNA, "M"=Nucleic acid residues (RNA, DNA or non-natural or modified nucleic acids) that do not base pair (hydrogen bond) with corresponding "M" residues of otherwise complementary strand when strands are annealed, "D"=DNA and "N"=1 to 50 or more, but is optionally 1-15 or, optionally, 1-8. "N*"=0 to 15 or more, but is optionally 0, 1, 2, 3, 4, 5 or 6. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand (first strand) is the sense strand, and the bottom strand (second strand) is the antisense strand. Alternatively, the bottom strand is the sense strand and the top strand is the antisense strand. Modification and DNA:DNA extension patterns paralleling those shown above for asymmetric/overhang agents can also be incorporated into such "blunt/frayed" agents.

In one embodiment, a length-extended DsiRNA agent is provided that comprises deoxyribonucleotides positioned at sites modeled to function via specific direction of Dicer cleavage, yet which does not require the presence of a base-paired deoxyribonucleotide in the dsRNA structure. An exemplary structure for such a molecule is shown:

5'-XXXXXXXXXXXXXXXXXXXXDDXX-3'

3'-YXXXXXXXXXXXXXXXXXXXXDDXXXX-5' wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "D"=DNA. In one embodiment, the top strand is the sense strand, and the bottom strand is the antisense strand. Alternatively, the bottom strand is the sense strand and the top strand is the antisense strand. The above structure is modeled to force Dicer to cleave a minimum of a 21mer duplex as its primary post-processing form. In embodiments where the bottom strand of the above structure is the antisense strand, the positioning of two deoxyribonucleotide residues at the ultimate and penultimate residues of the 5' end of the antisense strand will help reduce off-target effects (as prior studies have shown a 2'-O-methyl modification of at least the penultimate position from the 5' terminus of the antisense strand to reduce off-target effects; see, e.g., US 2007/0223427).

In one embodiment, the DsiRNA comprises the following (an exemplary "left-extended", "DNA extended" DsiRNA):

5'-D$_N$XXXXXXXXXXXXXXXXXXXXXXXX$_{N*}$Y-3'

3'-D$_N$XXXXXXXXXXXXXXXXXXXXXXXX$_{N*}$-5' wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In a related embodiment, the DsiRNA comprises:

5'-D$_N$XXXXXXXXXXXXXXXXXXXXXXXX$_{N*}$DD-3'

3'-D$_N$XXXXXXXXXXXXXXXXXXXXXXXX$_{N*}$XX-5' wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In an additional embodiment, the DsiRNA comprises:

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. "Z"=DNA or RNA. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

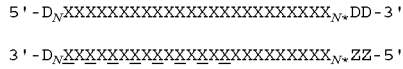

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. "Z"=DNA or RNA. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

wherein "X"=RNA, "$\underline{X}$"=2'-O-methyl RNA, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

wherein "X"=RNA, "$\underline{X}$"=2'-O-methyl RNA, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers.

In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DsiRNA comprises:

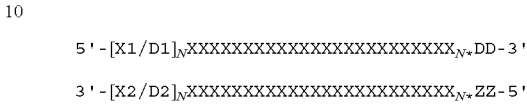

wherein "X"=RNA, "D"=DNA, "Z"=DNA or RNA, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding D2N, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In a related embodiment, the DsiRNA comprises:

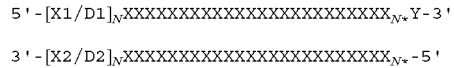

wherein "X"=RNA, "D"=DNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "N"=1 to 50 or more, but is optionally 1-8 or 1-10, where at least one $D1_N$ is present in the top strand and is base paired with a corresponding $D2_N$ in the bottom strand. Optionally, $D1_N$ and D1N+1 are base paired with corresponding $D2_N$ and $D2_{N+1}$; $D1_N$, $D1_{N+1}$ and $D1_{N+2}$ are base paired with corresponding D2N, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DNA:DNA-extended DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary DNA:DNA-extended DsiRNA agent with two terminal mismatched residues is shown:

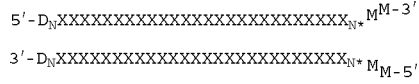

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed, "D"=DNA and "N"=1 to 50 or more, but is optionally 1-8 or 1-10. "N*"=0 to 15 or more, but is optionally 0, 1, 2, 3, 4, 5 or 6. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand (first strand) is the sense strand, and the bottom strand (second strand) is the antisense strand. Alternatively, the bottom strand is the sense strand and the top strand is the antisense strand. Modification and DNA:DNA extension patterns paralleling those shown above for asymmetric/overhang agents can also be incorporated into such "blunt/frayed" agents.

In another embodiment, a length-extended DsiRNA agent is provided that comprises deoxyribonucleotides positioned at sites modeled to function via specific direction of Dicer cleavage, yet which does not require the presence of a base-paired deoxyribonucleotide in the dsRNA structure. Exemplary structures for such a molecule are shown:

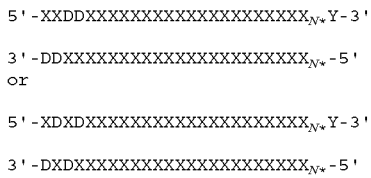

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "D"=DNA. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In any of the above embodiments where the bottom strand of the above structure is the antisense strand, the positioning of two deoxyribonucleotide residues at the ultimate and penultimate residues of the 5' end of the antisense strand will help reduce off-target effects (as prior studies have shown a 2'-O-methyl modification of at least the penultimate position from the 5' terminus of the antisense strand to reduce off-target effects; see, e.g., US 2007/0223427).

In certain embodiments, the "D" residues of the above structures include at least one PS-DNA or PS-RNA. Optionally, the "D" residues of the above structures include at least one modified nucleotide that inhibits Dicer cleavage.

While the above-described "DNA-extended" DsiRNA agents can be categorized as either "left extended" or "right extended", DsiRNA agents comprising both left- and right-extended DNA-containing sequences within a single agent (e.g., both flanks surrounding a core dsRNA structure are dsDNA extensions) can also be generated and used in similar manner to those described herein for "right-extended" and "left-extended" agents.

In some embodiments, the DsiRNA of the instant invention further comprises a linking moiety or domain that joins the sense and antisense strands of a DNA:DNA-extended DsiRNA agent. Optionally, such a linking moiety domain joins the 3' end of the sense strand and the 5' end of the antisense strand. The linking moiety may be a chemical (non-nucleotide) linker, such as an oligomethylenediol linker, oligoethylene glycol linker, or other art-recognized linker moiety. Alternatively, the linker can be a nucleotide linker, optionally including an extended loop and/or tetraloop.

In one embodiment, the DsiRNA agent has an asymmetric structure, with the sense strand having a 25-base pair length, and the antisense strand having a 27-base pair length with a 1-4 base 3'-overhang (e.g., a one base 3'-overhang, a two base 3'-overhang, a three base 3'-overhang or a four base 3'-overhang). In another embodiment, this DsiRNA agent has an asymmetric structure further containing 2 deoxynucleotides at the 3' end of the sense strand.

In another embodiment, the DsiRNA agent has an asymmetric structure, with the antisense strand having a 25-base pair length, and the sense strand having a 27-base pair length with a 1-4 base 3'-overhang (e.g., a one base 3'-overhang, a two base 3'-overhang, a three base 3'-overhang or a four base 3'-overhang). In another embodiment, this DsiRNA agent has an asymmetric structure further containing 2 deoxyribonucleotides at the 3' end of the antisense strand.

Exemplary AT3 targeting DsiRNA agents of the invention, and their associated AT3 target sequences, include the following, presented in the below series of tables:
Table Number:
(2) Selected Human Anti-AT3 DsiRNA Agents (Asymmetrics);
(3) Selected Human Anti-AT3 DsiRNAs, Unmodified Duplexes (Asymmetrics);
(4) DsiRNA Target Sequences (21mers) in AT3 mRNA;
(5) Selected Human Anti-AT3 "Blunt/Blunt" DsiRNAs; and
(6) DsiRNA Component 19 Nucleotide Target Sequences in AT3 mRNA

TABLE 2

Selected Human Anti-AT3 DsiRNA Agents (Asymmetrics)

| | | |
|---|---|---|
| | 5'-CCAUGUAUUCCAAUGUGAUAGGAac-3' | (SEQ ID NO: 1) |
| | 3'-CCGGUACAUAAGGUUACACUAUCCUUG-5' | (SEQ ID NO: 385) |
| AT3-142 Target: | 5'-GGCCATGTATTCCAATGTGATAGGAAC-3' | (SEQ ID NO: 769) |
| | 5'-CAUGUAUUCCAAUGUGAUAGGAACt-3' | (SEQ ID NO: 2) |
| | 3'-CGGUACAUAAGGUUACACUAUCCUUGA-5' | (SEQ ID NO: 386) |
| AT3-143 Target: | 5'-GCCATGTATTCCAATGTGATAGGAACT-3' | (SEQ ID NO: 770) |
| | 5'-AUGUAUUCCAAUGUGAUAGGAACtg-3' | (SEQ ID NO: 3) |
| | 3'-GGUACAUAAGGUUACACUAUCCUUGAC-5' | (SEQ ID NO: 387) |
| AT3-144 Target: | 5'-CCATGTATTCCAATGTGATAGGAACTG-3' | (SEQ ID NO: 771) |

TABLE 2-continued

Selected Human Anti-AT3 DsiRNA Agents (Asymmetrics)

| | | |
|---|---|---|
| AT3-145 Target: | 5'-UGUAUUCCAAUGUGAUAGGAACUgt-3'<br>3'-GUACAUAAGGUUACACUAUCCUUGACA-5'<br>5'-CATGTATTCCAATGTGATAGGAACTGT-3' | (SEQ ID NO: 4)<br>(SEQ ID NO: 388)<br>(SEQ ID NO: 772) |
| AT3-146 Target: | 5'-GUAUUCCAAUGUGAUAGGAACUGta-3'<br>3'-UACAUAAGGUUACACUAUCCUUGACAU-5'<br>5'-ATGTATTCCAATGTGATAGGAACTGTA-3' | (SEQ ID NO: 5)<br>(SEQ ID NO: 389)<br>(SEQ ID NO: 773) |
| AT3-147 Target: | 5'-UAUUCCAAUGUGAUAGGAACUGUaa-3'<br>3'-ACAUAAGGUUACACUAUCCUUGACAUU-5'<br>5'-TGTATTCCAATGTGATAGGAACTGTAA-3' | (SEQ ID NO: 6)<br>(SEQ ID NO: 390)<br>(SEQ ID NO: 774) |
| AT3-148 Target: | 5'-AUUCCAAUGUGAUAGGAACUGUAac-3'<br>3'-CAUAAGGUUACACUAUCCUUGACAUUG-5'<br>5'-GTATTCCAATGTGATAGGAACTGTAAC-3' | (SEQ ID NO: 7)<br>(SEQ ID NO: 391)<br>(SEQ ID NO: 775) |
| AT3-173 Target: | 5'-CUCUGGAAAAAGGAAGGUUUAUCtt-3'<br>3'-UGGAGACCUUUUUCCUUCCAAAUAGAA-5'<br>5'-ACCTCTGGAAAAAGGAAGGTTTATCTT-3' | (SEQ ID NO: 8)<br>(SEQ ID NO: 392)<br>(SEQ ID NO: 776) |
| AT3-174 Target: | 5'-UCUGGAAAAAGGAAGGUUUAUCUtt-3'<br>3'-GGAGACCUUUUUCCUUCCAAAUAGAAA-5'<br>5'-CCTCTGGAAAAAGGAAGGTTTATCTTT-3' | (SEQ ID NO: 9)<br>(SEQ ID NO: 393)<br>(SEQ ID NO: 777) |
| AT3-175 Target: | 5'-CUGGAAAAAGGAAGGUUUAUCUUtt-3'<br>3'-GAGACCUUUUUCCUUCCAAAUAGAAAA-5'<br>5'-CTCTGGAAAAAGGAAGGTTTATCTTTT-3' | (SEQ ID NO: 10)<br>(SEQ ID NO: 394)<br>(SEQ ID NO: 778) |
| AT3-177 Target: | 5'-GGAAAAAGGAAGGUUUAUCUUUUgt-3'<br>3'-GACCUUUUUCCUUCCAAAUAGAAAACA-5'<br>5'-CTGGAAAAAGGAAGGTTTATCTTTTGT-3' | (SEQ ID NO: 11)<br>(SEQ ID NO: 395)<br>(SEQ ID NO: 779) |
| AT3-178 Target: | 5'-GAAAAAGGAAGGUUUAUCUUUUGtc-3'<br>3'-ACCUUUUUCCUUCCAAAUAGAAAACAG-5'<br>5'-TGGAAAAAGGAAGGTTTATCTTTTGTC-3' | (SEQ ID NO: 12)<br>(SEQ ID NO: 396)<br>(SEQ ID NO: 780) |
| AT3-179 Target: | 5'-AAAAAGGAAGGUUUAUCUUUUGUcc-3'<br>3'-CCUUUUUCCUUCCAAAUAGAAAACAGG-5'<br>5'-GGAAAAAGGAAGGTTTATCTTTTGTCC-3' | (SEQ ID NO: 13)<br>(SEQ ID NO: 397)<br>(SEQ ID NO: 781) |
| AT3-284 Target: | 5'-UCCCAUGAAUCCCAUGUGCAUUUac-3'<br>3'-UAAGGGUACUUAGGGUACACGUAAAUG-5'<br>5'-ATTCCCATGAATCCCATGTGCATTTAC-3' | (SEQ ID NO: 14)<br>(SEQ ID NO: 398)<br>(SEQ ID NO: 782) |
| AT3-285 Target: | 5'-CCCAUGAAUCCCAUGUGCAUUUAcc-3'<br>3'-AAGGGUACUUAGGGUACACGUAAAUGG-5'<br>5'-TTCCCATGAATCCCATGTGCATTTACC-3' | (SEQ ID NO: 15)<br>(SEQ ID NO: 399)<br>(SEQ ID NO: 783) |
| AT3-288 Target: | 5'-AUGAAUCCCAUGUGCAUUUACCgct-3'<br>3'-GGUACUUAGGGUACACGUAAAUGGCGA-5'<br>5'-CCATGAATCCCATGTGCATTTACCGCT-3' | (SEQ ID NO: 16)<br>(SEQ ID NO: 400)<br>(SEQ ID NO: 784) |
| AT3-298 Target: | 5'-UGUGCAUUUACCGCUCCCCGGAGaa-3'<br>3'-GUACACGUAAAUGGCGAGGGGCCUCUU-5'<br>5'-CATGTGCATTTACCGCTCCCCGGAGAA-3' | (SEQ ID NO: 17)<br>(SEQ ID NO: 401)<br>(SEQ ID NO: 785) |
| AT3-381 Target: | 5'-GUCUGGGAACUGUCCAAGGCCAAtt-3'<br>3'-CACAGACCCUUGACAGGUUCCGGUUAA-5'<br>5'-GTGTCTGGGAACTGTCCAAGGCCAATT-3' | (SEQ ID NO: 18)<br>(SEQ ID NO: 402)<br>(SEQ ID NO: 786) |
| AT3-382 Target: | 5'-UCUGGGAACUGUCCAAGGCCAAUtc-3'<br>3'-ACAGACCCUUGACAGGUUCCGGUUAAG-5'<br>5'-TGTCTGGGAACTGTCCAAGGCCAATTC-3' | (SEQ ID NO: 19)<br>(SEQ ID NO: 403)<br>(SEQ ID NO: 787) |
| AT3-383 Target: | 5'-CUGGGAACUGUCCAAGGCCAAUUcc-3'<br>3'-CAGACCCUUGACAGGUUCCGGUUAAGG-5'<br>5'-GTCTGGGAACTGTCCAAGGCCAATTCC-3' | (SEQ ID NO: 20)<br>(SEQ ID NO: 404)<br>(SEQ ID NO: 788) |
| AT3-384 Target: | 5'-UGGGAACUGUCCAAGGCCAAUUCcc-3'<br>3'-AGACCCUUGACAGGUUCCGGUUAAGGG-5'<br>5'-TCTGGGAACTGTCCAAGGCCAATTCCC-3' | (SEQ ID NO: 21)<br>(SEQ ID NO: 405)<br>(SEQ ID NO: 789) |
| AT3-385 Target: | 5'-GGGAACUGUCCAAGGCCAAUUCCcg-3'<br>3'-GACCCUUGACAGGUUCCGGUUAAGGGC-5'<br>5'-CTGGGAACTGTCCAAGGCCAATTCCCG-3' | (SEQ ID NO: 22)<br>(SEQ ID NO: 406)<br>(SEQ ID NO: 790) |

TABLE 2-continued

Selected Human Anti-AT3 DsiRNA Agents (Asymmetrics)

|  |  |  |  |
|---|---|---|---|
| AT3-386 | Target: | 5'-GGAACUGUCCAAGGCCAAUUCCCgc-3'<br>3'-ACCCUUGACAGGUUCCGGUUAAGGGGCG-5'<br>5'-TGGGAACTGTCCAAGGCCAATTCCCGC-3' | (SEQ ID NO: 23)<br>(SEQ ID NO: 407)<br>(SEQ ID NO: 791) |
| AT3-387 | Target: | 5'-GAACUGUCCAAGGCCAAUUCCCGct-3'<br>3'-CCCUUGACAGGUUCCGGUUAAGGGCGA-5'<br>5'-GGGAACTGTCCAAGGCCAATTCCCGCT-3' | (SEQ ID NO: 24)<br>(SEQ ID NO: 408)<br>(SEQ ID NO: 792) |
| AT3-388 | Target: | 5'-AACUGUCCAAGGCCAAUUCCCGCtt-3'<br>3'-CCUUGACAGGUUCCGGUUAAGGGCGAA-5'<br>5'-GGAACTGTCCAAGGCCAATTCCCGCTT-3' | (SEQ ID NO: 25)<br>(SEQ ID NO: 409)<br>(SEQ ID NO: 793) |
| AT3-403 | Target: | 5'-AUUCCCGCUUUGCUACCACUUUCta-3'<br>3'-GUUAAGGGCGAAACGAUGGUGAAAGAU-5'<br>5'-CAATTCCCGCTTTGCTACCACTTTCTA-3' | (SEQ ID NO: 26)<br>(SEQ ID NO: 410)<br>(SEQ ID NO: 794) |
| AT3-406 | Target: | 5'-CCCGCUUUGCUACCACUUUCUAUca-3'<br>3'-AAGGGCGAAACGAUGGUGAAAGAUAGU-5'<br>5'-TTCCCGCTTTGCTACCACTTTCTATCA-3' | (SEQ ID NO: 27)<br>(SEQ ID NO: 411)<br>(SEQ ID NO: 795) |
| AT3-407 | Target: | 5'-CCGCUUUGCUACCACUUUCUAUCag-3'<br>3'-AGGGCGAAACGAUGGUGAAAGAUAGUC-5'<br>5'-TCCCGCTTTGCTACCACTTTCTATCAG-3' | (SEQ ID NO: 28)<br>(SEQ ID NO: 412)<br>(SEQ ID NO: 796) |
| AT3-408 | Target: | 5'-CGCUUUGCUACCACUUUCUAUCAgc-3'<br>3'-GGGCGAAACGAUGGUGAAAGAUAGUCG-5'<br>5'-CCCGCTTTGCTACCACTTTCTATCAGC-3' | (SEQ ID NO: 29)<br>(SEQ ID NO: 413)<br>(SEQ ID NO: 797) |
| AT3-409 | Target: | 5'-GCUUUGCUACCACUUUCUAUCAGca-3'<br>3'-GGCGAAACGAUGGUGAAAGAUAGUCGU-5'<br>5'-CCGCTTTGCTACCACTTTCTATCAGCA-3' | (SEQ ID NO: 30)<br>(SEQ ID NO: 414)<br>(SEQ ID NO: 798) |
| AT3-410 | Target: | 5'-CUUUGCUACCACUUUCUAUCAGCac-3'<br>3'-GCGAAACGAUGGUGAAAGAUAGUCGUG-5'<br>5'-CGCTTTGCTACCACTTTCTATCAGCAC-3' | (SEQ ID NO: 31)<br>(SEQ ID NO: 415)<br>(SEQ ID NO: 799) |
| AT3-411 | Target: | 5'-UUUGCUACCACUUUCUAUCAGCAcc-3'<br>3'-CGAAACGAUGGUGAAAGAUAGUCGUGG-5'<br>5'-GCTTTGCTACCACTTTCTATCAGCACC-3' | (SEQ ID NO: 32)<br>(SEQ ID NO: 416)<br>(SEQ ID NO: 800) |
| AT3-412 | Target: | 5'-UUGCUACCACUUUCUAUCAGCACct-3'<br>3'-GAAACGAUGGUGAAAGAUAGUCGUGGA-5'<br>5'-CTTTGCTACCACTTTCTATCAGCACCT-3' | (SEQ ID NO: 33)<br>(SEQ ID NO: 417)<br>(SEQ ID NO: 801) |
| AT3-413 | Target: | 5'-UGCUACCACUUUCUAUCAGCACCtg-3'<br>3'-AAACGAUGGUGAAAGAUAGUCGUGGAC-5'<br>5'-TTTGCTACCACTTTCTATCAGCACCTG-3' | (SEQ ID NO: 34)<br>(SEQ ID NO: 418)<br>(SEQ ID NO: 802) |
| AT3-414 | Target: | 5'-GCUACCACUUUCUAUCAGCACCUgg-3'<br>3'-AACGAUGGUGAAAGAUAGUCGUGGACC-5'<br>5'-TTGCTACCACTTTCTATCAGCACCTGG-3' | (SEQ ID NO: 35)<br>(SEQ ID NO: 419)<br>(SEQ ID NO: 803) |
| AT3-433 | Target: | 5'-ACCUGGCAGAUUCCAAGAAUGACaa-3'<br>3'-CGUGGACCGUCUAAGGUUCUUACUGUU-5'<br>5'-GCACCTGGCAGATTCCAAGAATGACAA-3' | (SEQ ID NO: 36)<br>(SEQ ID NO: 420)<br>(SEQ ID NO: 804) |
| AT3-459 | Target: | 5'-GAUAACAUUUUCCUGUCACCCCUga-3'<br>3'-UACUAUUGUAAAAGGACAGUGGGGACU-5'<br>5'-ATGATAACATTTTCCTGTCACCCCTGA-3' | (SEQ ID NO: 37)<br>(SEQ ID NO: 421)<br>(SEQ ID NO: 805) |
| AT3-462 | Target: | 5'-AACAUUUUCCUGUCACCCCUGAGta-3'<br>3'-UAUUGUAAAAGGACAGUGGGGACUCAU-5'<br>5'-ATAACATTTTCCTGTCACCCCTGAGTA-3' | (SEQ ID NO: 38)<br>(SEQ ID NO: 422)<br>(SEQ ID NO: 806) |
| AT3-464 | Target: | 5'-CAUUUUCCUGUCACCCCUGAGUAtc-3'<br>3'-UUGUAAAAGGACAGUGGGGACUCAUAG-5'<br>5'-AACATTTTCCTGTCACCCCTGAGTATC-3' | (SEQ ID NO: 39)<br>(SEQ ID NO: 423)<br>(SEQ ID NO: 807) |
| AT3-495 | Target: | 5'-GCUUUUGCUAUGACCAAGCUGGGtg-3'<br>3'-GCCGAAAACGAUACUGGUUCGACCCAC-5'<br>5'-CGGCTTTTGCTATGACCAAGCTGGGTG-3' | (SEQ ID NO: 40)<br>(SEQ ID NO: 424)<br>(SEQ ID NO: 808) |
| AT3-496 | Target: | 5'-CUUUUGCUAUGACCAAGCUGGGUgc-3'<br>3'-CCGAAAACGAUACUGGUUCGACCCACG-5'<br>5'-GGCTTTTGCTATGACCAAGCTGGGTGC-3' | (SEQ ID NO: 41)<br>(SEQ ID NO: 425)<br>(SEQ ID NO: 809) |

TABLE 2-continued

Selected Human Anti-AT3 DsiRNA Agents (Asymmetrics)

```
                   5'-UUUUGCUAUGACCAAGCUGGGUGcc-3'    (SEQ ID NO: 42)
                   3'-CGAAAACGAUACUGGUUCGACCCACGG-5'  (SEQ ID NO: 426)
AT3-497 Target:    5'-GCTTTTGCTATGACCAAGCTGGGTGCC-3'  (SEQ ID NO: 810)

5'-UUUGCUAUGACCAAGCUGGGUGCct-3'    (SEQ ID NO: 43)
                   3'-GAAAACGAUACUGGUUCGACCCACGGA-5'  (SEQ ID NO: 427)
AT3-498 Target:    5'-CTTTTGCTATGACCAAGCTGGGTGCCT-3'  (SEQ ID NO: 811)

5'-UUGCUAUGACCAAGCUGGGUGCCtg-3'    (SEQ ID NO: 44)
                   3'-AAAACGAUACUGGUUCGACCCACGGAC-5'  (SEQ ID NO: 428)
AT3-499 Target:    5'-TTTTGCTATGACCAAGCTGGGTGCCTG-3'  (SEQ ID NO: 812)

5'-UGCUAUGACCAAGCUGGGUGCCUgt-3'    (SEQ ID NO: 45)
                   3'-AAACGAUACUGGUUCGACCCACGGACA-5'  (SEQ ID NO: 429)
AT3-500 Target:    5'-TTTGCTATGACCAAGCTGGGTGCCTGT-3'  (SEQ ID NO: 813)

5'-GCUAUGACCAAGCUGGGUGCCUGta-3'    (SEQ ID NO: 46)
                   3'-AACGAUACUGGUUCGACCCACGGACAU-5'  (SEQ ID NO: 430)
AT3-501 Target:    5'-TTGCTATGACCAAGCTGGGTGCCTGTA-3'  (SEQ ID NO: 814)

5'-CUAUGACCAAGCUGGGUGCCUGUaa-3'    (SEQ ID NO: 47)
                   3'-ACGAUACUGGUUCGACCCACGGACAUU-5'  (SEQ ID NO: 431)
AT3-502 Target:    5'-TGCTATGACCAAGCTGGGTGCCTGTAA-3'  (SEQ ID NO: 815)

5'-UAUGACCAAGCUGGGUGCCUGUAat-3'    (SEQ ID NO: 48)
                   3'-CGAUACUGGUUCGACCCACGGACAUUA-5'  (SEQ ID NO: 432)
AT3-503 Target:    5'-GCTATGACCAAGCTGGGTGCCTGTAAT-3'  (SEQ ID NO: 816)

5'-AUGACCAAGCUGGGUGCCUGUAAtg-3'    (SEQ ID NO: 49)
                   3'-GAUACUGGUUCGACCCACGGACAUUAC-5'  (SEQ ID NO: 433)
AT3-504 Target:    5'-CTATGACCAAGCTGGGTGCCTGTAATG-3'  (SEQ ID NO: 817)

5'-UGACCAAGCUGGGUGCCUGUAAUga-3'    (SEQ ID NO: 50)
                   3'-AUACUGGUUCGACCCACGGACAUUACU-5'  (SEQ ID NO: 434)
AT3-505 Target:    5'-TATGACCAAGCTGGGTGCCTGTAATGA-3'  (SEQ ID NO: 818)

5'-GACCAAGCUGGGUGCCUGUAAUGac-3'    (SEQ ID NO: 51)
                   3'-UACUGGUUCGACCCACGGACAUUACUG-5'  (SEQ ID NO: 435)
AT3-506 Target:    5'-ATGACCAAGCTGGGTGCCTGTAATGAC-3'  (SEQ ID NO: 819)

5'-ACCAAGCUGGGUGCCUGUAAUGAca-3'    (SEQ ID NO: 52)
                   3'-ACUGGUUCGACCCACGGACAUUACUGU-5'  (SEQ ID NO: 436)
AT3-507 Target:    5'-TGACCAAGCTGGGTGCCTGTAATGACA-3'  (SEQ ID NO: 820)

5'-CCAAGCUGGGUGCCUGUAAUGACac-3'    (SEQ ID NO: 53)
                   3'-CUGGUUCGACCCACGGACAUUACUGUG-5'  (SEQ ID NO: 437)
AT3-508 Target:    5'-GACCAAGCTGGGTGCCTGTAATGACAC-3'  (SEQ ID NO: 821)

5'-AGCAACUGAUGGAGGUAUUUAAGtt-3'    (SEQ ID NO: 54)
                   3'-GGUCGUUGACUACCUCCAUAAAUUCAA-5'  (SEQ ID NO: 438)
AT3-538 Target:    5'-CCAGCAACTGATGGAGGTATTTAAGTT-3'  (SEQ ID NO: 822)

5'-GCAACUGAUGGAGGUAUUUAAGUtt-3'    (SEQ ID NO: 55)
                   3'-GUCGUUGACUACCUCCAUAAAUUCAAA-5'  (SEQ ID NO: 439)
AT3-539 Target:    5'-CAGCAACTGATGGAGGTATTTAAGTTT-3'  (SEQ ID NO: 823)

5'-CAACUGAUGGAGGUAUUUAAGUUtg-3'    (SEQ ID NO: 56)
                   3'-UCGUUGACUACCUCCAUAAAUUCAAAC-5'  (SEQ ID NO: 440)
AT3-540 Target:    5'-AGCAACTGATGGAGGTATTTAAGTTTG-3'  (SEQ ID NO: 824)

5'-AACUGAUGGAGGUAUUUAAGUUUga-3'    (SEQ ID NO: 57)
                   3'-CGUUGACUACCUCCAUAAAUUCAAACU-5'  (SEQ ID NO: 441)
AT3-541 Target:    5'-GCAACTGATGGAGGTATTTAAGTTTGA-3'  (SEQ ID NO: 825)

5'-ACUGAUGGAGGUAUUUAAGUUUGac-3'    (SEQ ID NO: 58)
                   3'-GUUGACUACCUCCAUAAAUUCAAACUG-5'  (SEQ ID NO: 442)
AT3-542 Target:    5'-CAACTGATGGAGGTATTTAAGTTTGAC-3'  (SEQ ID NO: 826)

5'-CUGAUGGAGGUAUUUAAGUUUGAca-3'    (SEQ ID NO: 59)
                   3'-UUGACUACCUCCAUAAAUUCAAACUGU-5'  (SEQ ID NO: 443)
AT3-543 Target:    5'-AACTGATGGAGGTATTTAAGTTTGACA-3'  (SEQ ID NO: 827)

5'-UGAUGGAGGUAUUUAAGUUUGACac-3'    (SEQ ID NO: 60)
                   3'-UGACUACCUCCAUAAAUUCAAACUGUG-5'  (SEQ ID NO: 444)
AT3-544 Target:    5'-ACTGATGGAGGTATTTAAGTTTGACAC-3'  (SEQ ID NO: 828)
```

TABLE 2-continued

Selected Human Anti-AT3 DsiRNA Agents (Asymmetrics)

| | | |
|---|---|---|
| AT3-545 Target: | 5'-GAUGGAGGUAUUUAAGUUUGACAcc-3'<br>3'-GACUACCUCCAUAAAUUCAAACUGUGG-5'<br>5'-CTGATGGAGGTATTTAAGTTTGACACC-3' | (SEQ ID NO: 61)<br>(SEQ ID NO: 445)<br>(SEQ ID NO: 829) |
| AT3-546 Target: | 5'-AUGGAGGUAUUUAAGUUUGACACCa-3'<br>3'-ACUACCUCCAUAAAUUCAAACUGUGGU-5'<br>5'-TGATGGAGGTATTTAAGTTTGACACCA-3' | (SEQ ID NO: 62)<br>(SEQ ID NO: 446)<br>(SEQ ID NO: 830) |
| AT3-547 Target: | 5'-UGGAGGUAUUUAAGUUUGACACCat-3'<br>3'-CUACCUCCAUAAAUUCAAACUGUGGUA-5'<br>5'-GATGGAGGTATTTAAGTTTGACACCAT-3' | (SEQ ID NO: 63)<br>(SEQ ID NO: 447)<br>(SEQ ID NO: 831) |
| AT3-548 Target: | 5'-GGAGGUAUUUAAGUUUGACACCAta-3'<br>3'-UACCUCCAUAAAUUCAAACUGUGGUAU-5'<br>5'-ATGGAGGTATTTAAGTTTGACACCATA-3' | (SEQ ID NO: 64)<br>(SEQ ID NO: 448)<br>(SEQ ID NO: 832) |
| AT3-549 Target: | 5'-GAGGUAUUUAAGUUUGACACCAUat-3'<br>3'-ACCUCCAUAAAUUCAAACUGUGGUAUA-5'<br>5'-TGGAGGTATTTAAGTTTGACACCATAT-3' | (SEQ ID NO: 65)<br>(SEQ ID NO: 449)<br>(SEQ ID NO: 833) |
| AT3-550 Target: | 5'-AGGUAUUUAAGUUUGACACCAUAtc-3'<br>3'-CCUCCAUAAAUUCAAACUGUGGUAUAG-5'<br>5'-GGAGGTATTTAAGTTTGACACCATATC-3' | (SEQ ID NO: 66)<br>(SEQ ID NO: 450)<br>(SEQ ID NO: 834) |
| AT3-551 Target: | 5'-GGUAUUUAAGUUUGACACCAUAUct-3'<br>3'-CUCCAUAAAUUCAAACUGUGGUAUAGA-5'<br>5'-GAGGTATTTAAGTTTGACACCATATCT-3' | (SEQ ID NO: 67)<br>(SEQ ID NO: 451)<br>(SEQ ID NO: 835) |
| AT3-552 Target: | 5'-GUAUUUAAGUUUGACACCAUAUCtg-3'<br>3'-UCCAUAAAUUCAAACUGUGGUAUAGAC-5'<br>5'-AGGTATTTAAGTTTGACACCATATCTG-3' | (SEQ ID NO: 68)<br>(SEQ ID NO: 452)<br>(SEQ ID NO: 836) |
| AT3-553 Target: | 5'-UAUUUAAGUUUGACACCAUAUCUga-3'<br>3'-CCAUAAAUUCAAACUGUGGUAUAGACU-5'<br>5'-GGTATTTAAGTTTGACACCATATCTGA-3' | (SEQ ID NO: 69)<br>(SEQ ID NO: 453)<br>(SEQ ID NO: 837) |
| AT3-554 Target: | 5'-AUUUAAGUUUGACACCAUAUCUGag-3'<br>3'-CAUAAAUUCAAACUGUGGUAUAGACUC-5'<br>5'-GTATTTAAGTTTGACACCATATCTGAG-3' | (SEQ ID NO: 70)<br>(SEQ ID NO: 454)<br>(SEQ ID NO: 838) |
| AT3-555 Target: | 5'-UUUAAGUUUGACACCAUAUCUGAga-3'<br>3'-AUAAAUUCAAACUGUGGUAUAGACUCU-5'<br>5'-TATTTAAGTTTGACACCATATCTGAGA-3' | (SEQ ID NO: 71)<br>(SEQ ID NO: 455)<br>(SEQ ID NO: 839) |
| AT3-556 Target: | 5'-UUAAGUUUGACACCAUAUCUGAGaa-3'<br>3'-UAAAUUCAAACUGUGGUAUAGACUCUU-5'<br>5'-ATTTAAGTTTGACACCATATCTGAGAA-3' | (SEQ ID NO: 72)<br>(SEQ ID NO: 456)<br>(SEQ ID NO: 840) |
| AT3-557 Target: | 5'-UAAGUUUGACACCAUAUCUGAGAaa-3'<br>3'-AAAUUCAAACUGUGGUAUAGACUCUUU-5'<br>5'-TTTAAGTTTGACACCATATCTGAGAAA-3' | (SEQ ID NO: 73)<br>(SEQ ID NO: 457)<br>(SEQ ID NO: 841) |
| AT3-558 Target: | 5'-AAGUUUGACACCAUAUCUGAGAAaa-3'<br>3'-AAUUCAAACUGUGGUAUAGACUCUUUU-5'<br>5'-TTAAGTTTGACACCATATCTGAGAAAA-3' | (SEQ ID NO: 74)<br>(SEQ ID NO: 458)<br>(SEQ ID NO: 842) |
| AT3-559 Target: | 5'-AGUUUGACACCAUAUCUGAGAAAac-3'<br>3'-AUUCAAACUGUGGUAUAGACUCUUUUG-5'<br>5'-TAAGTTTGACACCATATCTGAGAAAAC-3' | (SEQ ID NO: 75)<br>(SEQ ID NO: 459)<br>(SEQ ID NO: 843) |
| AT3-560 Target: | 5'-GUUUGACACCAUAUCUGAGAAAAca-3'<br>3'-UUCAAACUGUGGUAUAGACUCUUUUGU-5'<br>5'-AAGTTTGACACCATATCTGAGAAAACA-3' | (SEQ ID NO: 76)<br>(SEQ ID NO: 460)<br>(SEQ ID NO: 844) |
| AT3-561 Target: | 5'-UUUGACACCAUAUCUGAGAAAACat-3'<br>3'-UCAAACUGUGGUAUAGACUCUUUUGUA-5'<br>5'-AGTTTGACACCATATCTGAGAAAACAT-3' | (SEQ ID NO: 77)<br>(SEQ ID NO: 461)<br>(SEQ ID NO: 845) |
| AT3-562 Target: | 5'-UUGACACCAUAUCUGAGAAAACAtc-3'<br>3'-CAAACUGUGGUAUAGACUCUUUUGUAG-5'<br>5'-GTTTGACACCATATCTGAGAAAACATC-3' | (SEQ ID NO: 78)<br>(SEQ ID NO: 462)<br>(SEQ ID NO: 846) |
| AT3-563 Target: | 5'-UGACACCAUAUCUGAGAAAACAUct-3'<br>3'-AAACUGUGGUAUAGACUCUUUUGUAGA-5'<br>5'-TTTGACACCATATCTGAGAAAACATCT-3' | (SEQ ID NO: 79)<br>(SEQ ID NO: 463)<br>(SEQ ID NO: 847) |

TABLE 2-continued

Selected Human Anti-AT3 DsiRNA Agents (Asymmetrics)

```
                5'-GACACCAUAUCUGAGAAAACAUCtg-3'       (SEQ ID NO: 80)
                3'-AACUGUGGUAUAGACUCUUUUGUAGAC-5'     (SEQ ID NO: 464)
AT3-564 Target: 5'-TTGACACCATATCTGAGAAAACATCTG-3'     (SEQ ID NO: 848)

5'-ACACCAUAUCUGAGAAAACAUCUga-3'       (SEQ ID NO: 81)
                3'-ACUGUGGUAUAGACUCUUUUGUAGACU-5'     (SEQ ID NO: 465)
AT3-565 Target: 5'-TGACACCATATCTGAGAAAACATCTGA-3'     (SEQ ID NO: 849)

5'-CACCAUAUCUGAGAAAACAUCUGat-3'       (SEQ ID NO: 82)
                3'-CUGUGGUAUAGACUCUUUUGUAGACUA-5'     (SEQ ID NO: 466)
AT3-566 Target: 5'-GACACCATATCTGAGAAAACATCTGAT-3'     (SEQ ID NO: 850)

5'-ACCAUAUCUGAGAAAACAUCUGAtc-3'       (SEQ ID NO: 83)
                3'-UGUGGUAUAGACUCUUUUGUAGACUAG-5'     (SEQ ID NO: 467)
AT3-567 Target: 5'-ACACCATATCTGAGAAAACATCTGATC-3'     (SEQ ID NO: 851)

5'-CCAUAUCUGAGAAAACAUCUGAUca-3'       (SEQ ID NO: 84)
                3'-GUGGUAUAGACUCUUUUGUAGACUAGU-5'     (SEQ ID NO: 468)
AT3-568 Target: 5'-CACCATATCTGAGAAAACATCTGATCA-3'     (SEQ ID NO: 852)

5'-CAUAUCUGAGAAAACAUCUGAUCag-3'       (SEQ ID NO: 85)
                3'-UGGUAUAGACUCUUUUGUAGACUAGUC-5'     (SEQ ID NO: 469)
AT3-569 Target: 5'-ACCATATCTGAGAAAACATCTGATCAG-3'     (SEQ ID NO: 853)

5'-AUAUCUGAGAAAACAUCUGAUCAga-3'       (SEQ ID NO: 86)
                3'-GGUAUAGACUCUUUUGUAGACUAGUCU-5'     (SEQ ID NO: 470)
AT3-570 Target: 5'-CCATATCTGAGAAAACATCTGATCAGA-3'     (SEQ ID NO: 854)

5'-UAUCUGAGAAAACAUCUGAUCAGat-3'       (SEQ ID NO: 87)
                3'-GUAUAGACUCUUUUGUAGACUAGUCUA-5'     (SEQ ID NO: 471)
AT3-571 Target: 5'-CATATCTGAGAAAACATCTGATCAGAT-3'     (SEQ ID NO: 855)

5'-CUGAGAAAACAUCUGAUCAGAUCca-3'       (SEQ ID NO: 88)
                3'-UAGACUCUUUUGUAGACUAGUCUAGGU-5'     (SEQ ID NO: 472)
AT3-574 Target: 5'-ATCTGAGAAAACATCTGATCAGATCCA-3'     (SEQ ID NO: 856)

5'-UGAGAAAACAUCUGAUCAGAUCCac-3'       (SEQ ID NO: 89)
                3'-AGACUCUUUUGUAGACUAGUCUAGGUG-5'     (SEQ ID NO: 473)
AT3-575 Target: 5'-TCTGAGAAAACATCTGATCAGATCCAC-3'     (SEQ ID NO: 857)

5'-GAGAAAACAUCUGAUCAGAUCCAct-3'       (SEQ ID NO: 90)
                3'-GACUCUUUUGUAGACUAGUCUAGGUGA-5'     (SEQ ID NO: 474)
AT3-576 Target: 5'-CTGAGAAAACATCTGATCAGATCCACT-3'     (SEQ ID NO: 858)

5'-AGAAAACAUCUGAUCAGAUCCACtt-3'       (SEQ ID NO: 91)
                3'-ACUCUUUUGUAGACUAGUCUAGGUGAA-5'     (SEQ ID NO: 475)
AT3-577 Target: 5'-TGAGAAAACATCTGATCAGATCCACTT-3'     (SEQ ID NO: 859)

5'-AUCAGAUCCACUUCUUCUUUGCCaa-3'       (SEQ ID NO: 92)
                3'-ACUAGUCUAGGUGAAGAAGAAACGGUU-5'     (SEQ ID NO: 476)
AT3-589 Target: 5'-TGATCAGATCCACTTCTTCTTTGCCAA-3'     (SEQ ID NO: 860)

5'-CAGAUCCACUUCUUCUUUGCCAAac-3'       (SEQ ID NO: 93)
                3'-UAGUCUAGGUGAAGAAGAAACGGUUUG-5'     (SEQ ID NO: 477)
AT3-591 Target: 5'-ATCAGATCCACTTCTTCTTTGCCAAAC-3'     (SEQ ID NO: 861)

5'-AGAUCCACUUCUUCUUUGCCAAAct-3'       (SEQ ID NO: 94)
                3'-AGUCUAGGUGAAGAAGAAACGGUUUGA-5'     (SEQ ID NO: 478)
AT3-592 Target: 5'-TCAGATCCACTTCTTCTTTGCCAAACT-3'     (SEQ ID NO: 862)

5'-GAUCCACUUCUUCUUUGCCAAACtg-3'       (SEQ ID NO: 95)
                3'-GUCUAGGUGAAGAAGAAACGGUUUGAC-5'     (SEQ ID NO: 479)
AT3-593 Target: 5'-CAGATCCACTTCTTCTTTGCCAAACTG-3'     (SEQ ID NO: 863)

5'-AUCCACUUCUUCUUUGCCAAACUga-3'       (SEQ ID NO: 96)
                3'-UCUAGGUGAAGAAGAAACGGUUUGACU-5'     (SEQ ID NO: 480)
AT3-594 Target: 5'-AGATCCACTTCTTCTTTGCCAAACTGA-3'     (SEQ ID NO: 864)

5'-UCCACUUCUUCUUUGCCAAACUGaa-3'       (SEQ ID NO: 97)
                3'-CUAGGUGAAGAAGAAACGGUUUGACUU-5'     (SEQ ID NO: 481)
AT3-595 Target: 5'-GATCCACTTCTTCTTTGCCAAACTGAA-3'     (SEQ ID NO: 865)

5'-CCACUUCUUCUUUGCCAAACUGAac-3'       (SEQ ID NO: 98)
                3'-UAGGUGAAGAAGAAACGGUUUGACUUG-5'     (SEQ ID NO: 482)
AT3-596 Target: 5'-ATCCACTTCTTCTTTGCCAAACTGAAC-3'     (SEQ ID NO: 866)
```

TABLE 2-continued

Selected Human Anti-AT3 DsiRNA Agents (Asymmetrics)

|  |  |  |
|---|---|---|
| AT3-597 Target: | 5'-CACUUCUUCUUUGCCAAACUGAAct-3'<br>3'-AGGUGAAGAAGAAACGGUUUGACUUGA-5'<br>5'-TCCACTTCTTCTTTGCCAAACTGAACT-3' | (SEQ ID NO: 99)<br>(SEQ ID NO: 483)<br>(SEQ ID NO: 867) |
| AT3-598 Target: | 5'-ACUUCUUCUUUGCCAAACUGAACtg-3'<br>3'-GGUGAAGAAGAAACGGUUUGACUUGAC-5'<br>5'-CCACTTCTTCTTTGCCAAACTGAACTG-3' | (SEQ ID NO: 100)<br>(SEQ ID NO: 484)<br>(SEQ ID NO: 868) |
| AT3-599 Target: | 5'-CUUCUUCUUUGCCAAACUGAACUgc-3'<br>3'-GUGAAGAAGAAACGGUUUGACUUGACG-5'<br>5'-CACTTCTTCTTTGCCAAACTGAACTGC-3' | (SEQ ID NO: 101)<br>(SEQ ID NO: 485)<br>(SEQ ID NO: 869) |
| AT3-600 Target: | 5'-UUCUUCUUUGCCAAACUGAACUGcc-3'<br>3'-UGAAGAAGAAACGGUUUGACUUGACGG-5'<br>5'-ACTTCTTCTTTGCCAAACTGAACTGCC-3' | (SEQ ID NO: 102)<br>(SEQ ID NO: 486)<br>(SEQ ID NO: 870) |
| AT3-601 Target: | 5'-UCUUCUUUGCCAAACUGAACUGCcg-3'<br>3'-GAAGAAGAAACGGUUUGACUUGACGGC-5'<br>5'-CTTCTTCTTTGCCAAACTGAACTGCCG-3' | (SEQ ID NO: 103)<br>(SEQ ID NO: 487)<br>(SEQ ID NO: 871) |
| AT3-602 Target: | 5'-CUUCUUUGCCAAACUGAACUGCCga-3'<br>3'-AAGAAGAAACGGUUUGACUUGACGGCU-5'<br>5'-TTCTTCTTTGCCAAACTGAACTGCCGA-3' | (SEQ ID NO: 104)<br>(SEQ ID NO: 488)<br>(SEQ ID NO: 872) |
| AT3-603 Target: | 5'-UUCUUUGCCAAACUGAACUGCCGac-3'<br>3'-AGAAGAAACGGUUUGACUUGACGGCUG-5'<br>5'-TCTTCTTTGCCAAACTGAACTGCCGAC-3' | (SEQ ID NO: 105)<br>(SEQ ID NO: 489)<br>(SEQ ID NO: 873) |
| AT3-604 Target: | 5'-UCUUUGCCAAACUGAACUGCCGAct-3'<br>3'-GAAGAAACGGUUUGACUUGACGGCUGA-5'<br>5'-CTTCTTTGCCAAACTGAACTGCCGACT-3' | (SEQ ID NO: 106)<br>(SEQ ID NO: 490)<br>(SEQ ID NO: 874) |
| AT3-605 Target: | 5'-CUUUGCCAAACUGAACUGCCGACtc-3'<br>3'-AAGAAACGGUUUGACUUGACGGCUGAG-5'<br>5'-TTCTTTGCCAAACTGAACTGCCGACTC-3' | (SEQ ID NO: 107)<br>(SEQ ID NO: 491)<br>(SEQ ID NO: 875) |
| AT3-606 Target: | 5'-UUUGCCAAACUGAACUGCCGACUct-3'<br>3'-AGAAACGGUUUGACUUGACGGCUGAGA-5'<br>5'-TCTTTGCCAAACTGAACTGCCGACTCT-3' | (SEQ ID NO: 108)<br>(SEQ ID NO: 492)<br>(SEQ ID NO: 876) |
| AT3-607 Target: | 5'-UUGCCAAACUGAACUGCCGACUCta-3'<br>3'-GAAACGGUUUGACUUGACGGCUGAGAU-5'<br>5'-CTTTGCCAAACTGAACTGCCGACTCTA-3' | (SEQ ID NO: 109)<br>(SEQ ID NO: 493)<br>(SEQ ID NO: 877) |
| AT3-608 Target: | 5'-UGCCAAACUGAACUGCCGACUCUat-3'<br>3'-AAACGGUUUGACUUGACGGCUGAGAUA-5'<br>5'-TTTGCCAAACTGAACTGCCGACTCTAT-3' | (SEQ ID NO: 110)<br>(SEQ ID NO: 494)<br>(SEQ ID NO: 878) |
| AT3-609 Target: | 5'-GCCAAACUGAACUGCCGACUCUAtc-3'<br>3'-AACGGUUUGACUUGACGGCUGAGAUAG-5'<br>5'-TTGCCAAACTGAACTGCCGACTCTATC-3' | (SEQ ID NO: 111)<br>(SEQ ID NO: 495)<br>(SEQ ID NO: 879) |
| AT3-610 Target: | 5'-CCAAACUGAACUGCCGACUCUAUcg-3'<br>3'-ACGGUUUGACUUGACGGCUGAGAUAGC-5'<br>5'-TGCCAAACTGAACTGCCGACTCTATCG-3' | (SEQ ID NO: 112)<br>(SEQ ID NO: 496)<br>(SEQ ID NO: 880) |
| AT3-611 Target: | 5'-CAAACUGAACUGCCGACUCUAUCga-3'<br>3'-CGGUUUGACUUGACGGCUGAGAUAGCU-5'<br>5'-GCCAAACTGAACTGCCGACTCTATCGA-3' | (SEQ ID NO: 113)<br>(SEQ ID NO: 497)<br>(SEQ ID NO: 881) |
| AT3-612 Target: | 5'-AAACUGAACUGCCGACUCUAUCGaa-3'<br>3'-GGUUUGACUUGACGGCUGAGAUAGCUU-5'<br>5'-CCAAACTGAACTGCCGACTCTATCGAA-3' | (SEQ ID NO: 114)<br>(SEQ ID NO: 498)<br>(SEQ ID NO: 882) |
| AT3-613 Target: | 5'-AACUGAACUGCCGACUCUAUCGAaa-3'<br>3'-GUUUGACUUGACGGCUGAGAUAGCUUU-5'<br>5'-CAAACTGAACTGCCGACTCTATCGAAA-3' | (SEQ ID NO: 115)<br>(SEQ ID NO: 499)<br>(SEQ ID NO: 883) |
| AT3-614 Target: | 5'-ACUGAACUGCCGACUCUAUCGAAa-3'<br>3'-UUUGACUUGACGGCUGAGAUAGCUUUU-5'<br>5'-AAACTGAACTGCCGACTCTATCGAAAA-3' | (SEQ ID NO: 116)<br>(SEQ ID NO: 500)<br>(SEQ ID NO: 884) |
| AT3-615 Target: | 5'-CUGAACUGCCGACUCUAUCGAAAag-3'<br>3'-UUGACUUGACGGCUGAGAUAGCUUUUC-5'<br>5'-AACTGAACTGCCGACTCTATCGAAAAG-3' | (SEQ ID NO: 117)<br>(SEQ ID NO: 501)<br>(SEQ ID NO: 885) |

TABLE 2-continued

Selected Human Anti-AT3 DsiRNA Agents (Asymmetrics)

| | | |
|---|---|---|
| AT3-616 Target: | 5'-UGAACUGCCGACUCUAUCGAAAAgc-3'<br>3'-UGACUUGACGGCUGAGAUAGCUUUUCG-5'<br>5'-ACTGAACTGCCGACTCTATCGAAAAGC-3' | (SEQ ID NO: 118)<br>(SEQ ID NO: 502)<br>(SEQ ID NO: 886) |
| AT3-617 Target: | 5'-GAACUGCCGACUCUAUCGAAAAGcc-3'<br>3'-GACUUGACGGCUGAGAUAGCUUUUCGG-5'<br>5'-CTGAACTGCCGACTCTATCGAAAAGCC-3' | (SEQ ID NO: 119)<br>(SEQ ID NO: 503)<br>(SEQ ID NO: 887) |
| AT3-618 Target: | 5'-AACUGCCGACUCUAUCGAAAAGCca-3'<br>3'-ACUUGACGGCUGAGAUAGCUUUUCGGU-5'<br>5'-TGAACTGCCGACTCTATCGAAAAGCCA-3' | (SEQ ID NO: 120)<br>(SEQ ID NO: 504)<br>(SEQ ID NO: 888) |
| AT3-619 Target: | 5'-ACUGCCGACUCUAUCGAAAAGCCaa-3'<br>3'-CUUGACGGCUGAGAUAGCUUUUCGGUU-5'<br>5'-GAACTGCCGACTCTATCGAAAAGCCAA-3' | (SEQ ID NO: 121)<br>(SEQ ID NO: 505)<br>(SEQ ID NO: 889) |
| AT3-620 Target: | 5'-CUGCCGACUCUAUCGAAAAGCCAac-3'<br>3'-UUGACGGCUGAGAUAGCUUUUCGGUUG-5'<br>5'-AACTGCCGACTCTATCGAAAAGCCAAC-3' | (SEQ ID NO: 122)<br>(SEQ ID NO: 506)<br>(SEQ ID NO: 890) |
| AT3-621 Target: | 5'-UGCCGACUCUAUCGAAAAGCCAAca-3'<br>3'-UGACGGCUGAGAUAGCUUUUCGGUUGU-5'<br>5'-ACTGCCGACTCTATCGAAAAGCCAACA-3' | (SEQ ID NO: 123)<br>(SEQ ID NO: 507)<br>(SEQ ID NO: 891) |
| AT3-622 Target: | 5'-GCCGACUCUAUCGAAAAGCCAACaa-3'<br>3'-GACGGCUGAGAUAGCUUUUCGGUUGUU-5'<br>5'-CTGCCGACTCTATCGAAAAGCCAACAA-3' | (SEQ ID NO: 124)<br>(SEQ ID NO: 508)<br>(SEQ ID NO: 892) |
| AT3-623 Target: | 5'-CCGACUCUAUCGAAAAGCCAACAaa-3'<br>3'-ACGGCUGAGAUAGCUUUUCGGUUGUUU-5'<br>5'-TGCCGACTCTATCGAAAAGCCAACAAA-3' | (SEQ ID NO: 125)<br>(SEQ ID NO: 509)<br>(SEQ ID NO: 893) |
| AT3-624 Target: | 5'-CGACUCUAUCGAAAAGCCAACAAat-3'<br>3'-CGGCUGAGAUAGCUUUUCGGUUGUUUA-5'<br>5'-GCCGACTCTATCGAAAAGCCAACAAAT-3' | (SEQ ID NO: 126)<br>(SEQ ID NO: 510)<br>(SEQ ID NO: 894) |
| AT3-625 Target: | 5'-GACUCUAUCGAAAAGCCAACAAAtc-3'<br>3'-GGCUGAGAUAGCUUUUCGGUUGUUUAG-5'<br>5'-CCGACTCTATCGAAAAGCCAACAAATC-3' | (SEQ ID NO: 127)<br>(SEQ ID NO: 511)<br>(SEQ ID NO: 895) |
| AT3-626 Target: | 5'-ACUCUAUCGAAAAGCCAACAAAUcc-3'<br>3'-GCUGAGAUAGCUUUUCGGUUGUUUAGG-5'<br>5'-CGACTCTATCGAAAAGCCAACAAATCC-3' | (SEQ ID NO: 128)<br>(SEQ ID NO: 512)<br>(SEQ ID NO: 896) |
| AT3-627 Target: | 5'-CUCUAUCGAAAAGCCAACAAAUCct-3'<br>3'-CUGAGAUAGCUUUUCGGUUGUUUAGGA-5'<br>5'-GACTCTATCGAAAAGCCAACAAATCCT-3' | (SEQ ID NO: 129)<br>(SEQ ID NO: 513)<br>(SEQ ID NO: 897) |
| AT3-628 Target: | 5'-UCUAUCGAAAAGCCAACAAAUCCtc-3'<br>3'-UGAGAUAGCUUUUCGGUUGUUUAGGAG-5'<br>5'-ACTCTATCGAAAAGCCAACAAATCCTC-3' | (SEQ ID NO: 130)<br>(SEQ ID NO: 514)<br>(SEQ ID NO: 898) |
| AT3-635 Target: | 5'-AAAAGCCAACAAAUCCUCCAAGUta-3'<br>3'-GCUUUUCGGUUGUUUAGGAGGUUCAAU-5'<br>5'-CGAAAAGCCAACAAATCCTCCAAGTTA-3' | (SEQ ID NO: 131)<br>(SEQ ID NO: 515)<br>(SEQ ID NO: 899) |
| AT3-636 Target: | 5'-AAAGCCAACAAAUCCUCCAAGUUag-3'<br>3'-CUUUUCGGUUGUUUAGGAGGUUCAAUC-5'<br>5'-GAAAAGCCAACAAATCCTCCAAGTTAG-3' | (SEQ ID NO: 132)<br>(SEQ ID NO: 516)<br>(SEQ ID NO: 900) |
| AT3-639 Target: | 5'-GCCAACAAAUCCUCCAAGUUAGUat-3'<br>3'-UUCGGUUGUUUAGGAGGUUCAAUCAUA-5'<br>5'-AAGCCAACAAATCCTCCAAGTTAGTAT-3' | (SEQ ID NO: 133)<br>(SEQ ID NO: 517)<br>(SEQ ID NO: 901) |
| AT3-640 Target: | 5'-CCAACAAAUCCUCCAAGUUAGUAtc-3'<br>3'-UCGGUUGUUUAGGAGGUUCAAUCAUAG-5'<br>5'-AGCCAACAAATCCTCCAAGTTAGTATC-3' | (SEQ ID NO: 134)<br>(SEQ ID NO: 518)<br>(SEQ ID NO: 902) |
| AT3-641 Target: | 5'-CAACAAAUCCUCCAAGUUAGUAUca-3'<br>3'-CGGUUGUUUAGGAGGUUCAAUCAUAGU-5'<br>5'-GCCAACAAATCCTCCAAGTTAGTATCA-3' | (SEQ ID NO: 135)<br>(SEQ ID NO: 519)<br>(SEQ ID NO: 903) |
| AT3-642 Target: | 5'-AACAAAUCCUCCAAGUUAGUAUCag-3'<br>3'-GGUUGUUUAGGAGGUUCAAUCAUAGUC-5'<br>5'-CCAACAAATCCTCCAAGTTAGTATCAG-3' | (SEQ ID NO: 136)<br>(SEQ ID NO: 520)<br>(SEQ ID NO: 904) |

TABLE 2-continued

Selected Human Anti-AT3 DsiRNA Agents (Asymmetrics)

| | | |
|---|---|---|
| AT3-643 Target: | 5'-ACAAAUCCUCCAAGUUAGUAUCAgc-3'<br>3'-GUUGUUUAGGAGGUUCAAUCAUAGUCG-5'<br>5'-CAACAAATCCTCCAAGTTAGTATCAGC-3' | (SEQ ID NO: 137)<br>(SEQ ID NO: 521)<br>(SEQ ID NO: 905) |
| AT3-644 Target: | 5'-CAAAUCCUCCAAGUUAGUAUCAGcc-3'<br>3'-UUGUUUAGGAGGUUCAAUCAUAGUCGG-5'<br>5'-AACAAATCCTCCAAGTTAGTATCAGCC-3' | (SEQ ID NO: 138)<br>(SEQ ID NO: 522)<br>(SEQ ID NO: 906) |
| AT3-655 Target: | 5'-AGUUAGUAUCAGCCAAUCGCCUUtt-3'<br>3'-GUUCAAUCAUAGUCGGUUAGCGGAAAA-5'<br>5'-CAAGTTAGTATCAGCCAATCGCCTTTT-3' | (SEQ ID NO: 139)<br>(SEQ ID NO: 523)<br>(SEQ ID NO: 907) |
| AT3-659 Target: | 5'-AGUAUCAGCCAAUCGCCUUUUUGga-3'<br>3'-AAUCAUAGUCGGUUAGCGGAAAAACCU-5'<br>5'-TTAGTATCAGCCAATCGCCTTTTTGGA-3' | (SEQ ID NO: 140)<br>(SEQ ID NO: 524)<br>(SEQ ID NO: 908) |
| AT3-664 Target: | 5'-CAGCCAAUCGCCUUUUUGGAGACaa-3'<br>3'-UAGUCGGUUAGCGGAAAAACCUCUGUU-5'<br>5'-ATCAGCCAATCGCCTTTTTGGAGACAA-3' | (SEQ ID NO: 141)<br>(SEQ ID NO: 525)<br>(SEQ ID NO: 909) |
| AT3-665 Target: | 5'-AGCCAAUCGCCUUUUUGGAGACAaa-3'<br>3'-AGUCGGUUAGCGGAAAAACCUCUGUUU-5'<br>5'-TCAGCCAATCGCCTTTTTGGAGACAAA-3' | (SEQ ID NO: 142)<br>(SEQ ID NO: 526)<br>(SEQ ID NO: 910) |
| AT3-666 Target: | 5'-GCCAAUCGCCUUUUUGGAGACAAat-3'<br>3'-GUCGGUUAGCGGAAAAACCUCUGUUUA-5'<br>5'-CAGCCAATCGCCTTTTTGGAGACAAAT-3' | (SEQ ID NO: 143)<br>(SEQ ID NO: 527)<br>(SEQ ID NO: 911) |
| AT3-670 Target: | 5'-AUCGCCUUUUUGGAGACAAAUCCct-3'<br>3'-GUUAGCGGAAAAACCUCUGUUUAGGGA-5'<br>5'-CAATCGCCTTTTTGGAGACAAATCCCT-3' | (SEQ ID NO: 144)<br>(SEQ ID NO: 528)<br>(SEQ ID NO: 912) |
| AT3-672 Target: | 5'-CGCCUUUUUGGAGACAAAUCCCUta-3'<br>3'-UAGCGGAAAAACCUCUGUUUAGGGAAU-5'<br>5'-ATCGCCTTTTTGGAGACAAATCCCTTA-3' | (SEQ ID NO: 145)<br>(SEQ ID NO: 529)<br>(SEQ ID NO: 913) |
| AT3-673 Target: | 5'-GCCUUUUUGGAGACAAAUCCCUUac-3'<br>3'-AGCGGAAAAACCUCUGUUUAGGGAAUG-5'<br>5'-TCGCCTTTTTGGAGACAAATCCCTTAC-3' | (SEQ ID NO: 146)<br>(SEQ ID NO: 530)<br>(SEQ ID NO: 914) |
| AT3-674 Target: | 5'-CCUUUUUGGAGACAAAUCCCUUAcc-3'<br>3'-GCGGAAAACCUCUGUUUAGGGAAUGG-5'<br>5'-CGCCTTTTTGGAGACAAATCCCTTACC-3' | (SEQ ID NO: 147)<br>(SEQ ID NO: 531)<br>(SEQ ID NO: 915) |
| AT3-675 Target: | 5'-CUUUUUGGAGACAAAUCCCUUACct-3'<br>3'-CGGAAAAACCUCUGUUUAGGGAAUGGA-5'<br>5'-GCCTTTTTGGAGACAAATCCCTTACCT-3' | (SEQ ID NO: 148)<br>(SEQ ID NO: 532)<br>(SEQ ID NO: 916) |
| AT3-676 Target: | 5'-UUUUUGGAGACAAAUCCCUUACCtt-3'<br>3'-GGAAAAACCUCUGUUUAGGGAAUGGAA-5'<br>5'-CCTTTTTGGAGACAAATCCCTTACCTT-3' | (SEQ ID NO: 149)<br>(SEQ ID NO: 533)<br>(SEQ ID NO: 917) |
| AT3-680 Target: | 5'-UGGAGACAAAUCCCUUACCUUCAat-3'<br>3'-AAACCUCUGUUUAGGGAAUGGAAGUUA-5'<br>5'-TTTGGAGACAAATCCCTTACCTTCAAT-3' | (SEQ ID NO: 150)<br>(SEQ ID NO: 534)<br>(SEQ ID NO: 918) |
| AT3-681 Target: | 5'-GGAGACAAAUCCCUUACCUUCAAtg-3'<br>3'-AACCUCUGUUUAGGGAAUGGAAGUUAC-5'<br>5'-TTGGAGACAAATCCCTTACCTTCAATG-3' | (SEQ ID NO: 151)<br>(SEQ ID NO: 535)<br>(SEQ ID NO: 919) |
| AT3-682 Target: | 5'-GAGACAAAUCCCUUACCUUCAAUga-3'<br>3'-ACCUCUGUUUAGGGAAUGGAAGUUACU-5'<br>5'-TGGAGACAAATCCCTTACCTTCAATGA-3' | (SEQ ID NO: 152)<br>(SEQ ID NO: 536)<br>(SEQ ID NO: 920) |
| AT3-683 Target: | 5'-AGACAAAUCCCUUACCUUCAAUGag-3'<br>3'-CCUCUGUUUAGGGAAUGGAAGUUACUC-5'<br>5'-GGAGACAAATCCCTTACCTTCAATGAG-3' | (SEQ ID NO: 153)<br>(SEQ ID NO: 537)<br>(SEQ ID NO: 921) |
| AT3-684 Target: | 5'-GACAAAUCCCUUACCUUCAAUGAga-3'<br>3'-CUCUGUUUAGGGAAUGGAAGUUACUCU-5'<br>5'-GAGACAAATCCCTTACCTTCAATGAGA-3' | (SEQ ID NO: 154)<br>(SEQ ID NO: 538)<br>(SEQ ID NO: 922) |
| AT3-685 Target: | 5'-ACAAAUCCCUUACCUUCAAUGAGac-3'<br>3'-UCUGUUUAGGGAAUGGAAGUUACUCUG-5'<br>5'-AGACAAATCCCTTACCTTCAATGAGAC-3' | (SEQ ID NO: 155)<br>(SEQ ID NO: 539)<br>(SEQ ID NO: 923) |

TABLE 2-continued

Selected Human Anti-AT3 DsiRNA Agents (Asymmetrics)

| | | |
|---|---|---|
| AT3-687 Target: | 5'-AAAUCCCUUACCUUCAAUGAGACct-3'<br>3'-UGUUUAGGGAAUGGAAGUUACUCUGGA-5'<br>5'-ACAAATCCCTTACCTTCAATGAGACCT-3' | (SEQ ID NO: 156)<br>(SEQ ID NO: 540)<br>(SEQ ID NO: 924) |
| AT3-688 Target: | 5'-AAUCCCUUACCUUCAAUGAGACCta-3'<br>3'-GUUUAGGGAAUGGAAGUUACUCUGGAU-5'<br>5'-CAAATCCCTTACCTTCAATGAGACCTA-3' | (SEQ ID NO: 157)<br>(SEQ ID NO: 541)<br>(SEQ ID NO: 925) |
| AT3-689 Target: | 5'-AUCCCUUACCUUCAAUGAGACCUac-3'<br>3'-UUUAGGGAAUGGAAGUUACUCUGGAUG-5'<br>5'-AAATCCCTTACCTTCAATGAGACCTAC-3' | (SEQ ID NO: 158)<br>(SEQ ID NO: 542)<br>(SEQ ID NO: 926) |
| AT3-696 Target: | 5'-ACCUUCAAUGAGACCUACCAGGAca-3'<br>3'-AAUGGAAGUUACUCUGGAUGGUCCUGU-5'<br>5'-TTACCTTCAATGAGACCTACCAGGACA-3' | (SEQ ID NO: 159)<br>(SEQ ID NO: 543)<br>(SEQ ID NO: 927) |
| AT3-700 Target: | 5'-UCAAUGAGACCUACCAGGACAUCag-3'<br>3'-GAAGUUACUCUGGAUGGUCCUGUAGUC-5'<br>5'-CTTCAATGAGACCTACCAGGACATCAG-3' | (SEQ ID NO: 160)<br>(SEQ ID NO: 544)<br>(SEQ ID NO: 928) |
| AT3-701 Target: | 5'-CAAUGAGACCUACCAGGACAUCAgt-3'<br>3'-AAGUUACUCUGGAUGGUCCUGUAGUCA-5'<br>5'-TTCAATGAGACCTACCAGGACATCAGT-3' | (SEQ ID NO: 161)<br>(SEQ ID NO: 545)<br>(SEQ ID NO: 929) |
| AT3-702 Target: | 5'-AAUGAGACCUACCAGGACAUCAGtg-3'<br>3'-AGUUACUCUGGAUGGUCCUGUAGUCAC-5'<br>5'-TCAATGAGACCTACCAGGACATCAGTG-3' | (SEQ ID NO: 162)<br>(SEQ ID NO: 546)<br>(SEQ ID NO: 930) |
| AT3-704 Target: | 5'-UGAGACCUACCAGGACAUCAGUGag-3'<br>3'-UUACUCUGGAUGGUCCUGUAGUCACUC-5'<br>5'-AATGAGACCTACCAGGACATCAGTGAG-3' | (SEQ ID NO: 163)<br>(SEQ ID NO: 547)<br>(SEQ ID NO: 931) |
| AT3-706 Target: | 5'-AGACCUACCAGGACAUCAGUGAGtt-3'<br>3'-ACUCUGGAUGGUCCUGUAGUCACUCAA-5'<br>5'-TGAGACCTACCAGGACATCAGTGAGTT-3' | (SEQ ID NO: 164)<br>(SEQ ID NO: 548)<br>(SEQ ID NO: 932) |
| AT3-710 Target: | 5'-CUACCAGGACAUCAGUGAGUUGGta-3'<br>3'-UGGAUGGUCCUGUAGUCACUCAACCAU-5'<br>5'-ACCTACCAGGACATCAGTGAGTTGGTA-3' | (SEQ ID NO: 165)<br>(SEQ ID NO: 549)<br>(SEQ ID NO: 933) |
| AT3-711 Target: | 5'-UACCAGGACAUCAGUGAGUUGGUat-3'<br>3'-GGAUGGUCCUGUAGUCACUCAACCAUA-5'<br>5'-CCTACCAGGACATCAGTGAGTTGGTAT-3' | (SEQ ID NO: 166)<br>(SEQ ID NO: 550)<br>(SEQ ID NO: 934) |
| AT3-712 Target: | 5'-ACCAGGACAUCAGUGAGUUGGUAta-3'<br>3'-GAUGGUCCUGUAGUCACUCAACCAUAU-5'<br>5'-CTACCAGGACATCAGTGAGTTGGTATA-3' | (SEQ ID NO: 167)<br>(SEQ ID NO: 551)<br>(SEQ ID NO: 935) |
| AT3-713 Target: | 5'-CCAGGACAUCAGUGAGUUGGUAUat-3'<br>3'-AUGGUCCUGUAGUCACUCAACCAUAUA-5'<br>5'-TACCAGGACATCAGTGAGTTGGTATAT-3' | (SEQ ID NO: 168)<br>(SEQ ID NO: 552)<br>(SEQ ID NO: 936) |
| AT3-714 Target: | 5'-CAGGACAUCAGUGAGUUGGUAUAtg-3'<br>3'-UGGUCCUGUAGUCACUCAACCAUAUAC-5'<br>5'-ACCAGGACATCAGTGAGTTGGTATATG-3' | (SEQ ID NO: 169)<br>(SEQ ID NO: 553)<br>(SEQ ID NO: 937) |
| AT3-715 Target: | 5'-AGGACAUCAGUGAGUUGGUAUAUgg-3'<br>3'-GGUCCUGUAGUCACUCAACCAUAUACC-5'<br>5'-CCAGGACATCAGTGAGTTGGTATATGG-3' | (SEQ ID NO: 170)<br>(SEQ ID NO: 554)<br>(SEQ ID NO: 938) |
| AT3-716 Target: | 5'-GGACAUCAGUGAGUUGGUAUAUGga-3'<br>3'-GUCCUGUAGUCACUCAACCAUAUACCU-5'<br>5'-CAGGACATCAGTGAGTTGGTATATGGA-3' | (SEQ ID NO: 171)<br>(SEQ ID NO: 555)<br>(SEQ ID NO: 939) |
| AT3-717 Target: | 5'-GACAUCAGUGAGUUGGUAUAUGGag-3'<br>3'-UCCUGUAGUCACUCAACCAUAUACCUC-5'<br>5'-AGGACATCAGTGAGTTGGTATATGGAG-3' | (SEQ ID NO: 172)<br>(SEQ ID NO: 556)<br>(SEQ ID NO: 940) |
| AT3-718 Target: | 5'-ACAUCAGUGAGUUGGUAUAUGGAgc-3'<br>3'-CCUGUAGUCACUCAACCAUAUACCUCG-5'<br>5'-GGACATCAGTGAGTTGGTATATGGAGC-3' | (SEQ ID NO: 173)<br>(SEQ ID NO: 557)<br>(SEQ ID NO: 941) |
| AT3-735 Target: | 5'-UAUGGAGCCAAGCUCCAGCCCCUgg-3'<br>3'-AUAUACCUCGGUUCGAGGUCGGGGACC-5'<br>5'-TATATGGAGCCAAGCTCCAGCCCCTGG-3' | (SEQ ID NO: 174)<br>(SEQ ID NO: 558)<br>(SEQ ID NO: 942) |

TABLE 2-continued

Selected Human Anti-AT3 DsiRNA Agents (Asymmetrics)

|  |  |  |  |
|---|---|---|---|
| AT3-736 Target: | 5'-AUGGAGCCAAGCUCCAGCCCCUGGa-3'<br>3'-UAUACCUCGGUUCGAGGUCGGGGACCU-5'<br>5'-ATATGGAGCCAAGCTCCAGCCCCTGGA-3' | (SEQ ID NO: 175)<br>(SEQ ID NO: 559)<br>(SEQ ID NO: 943) | |
| AT3-737 Target: | 5'-UGGAGCCAAGCUCCAGCCCCUGGac-3'<br>3'-AUACCUCGGUUCGAGGUCGGGGACCUG-5'<br>5'-TATGGAGCCAAGCTCCAGCCCCTGGAC-3' | (SEQ ID NO: 176)<br>(SEQ ID NO: 560)<br>(SEQ ID NO: 944) | |
| AT3-738 Target: | 5'-GGAGCCAAGCUCCAGCCCCUGGAct-3'<br>3'-UACCUCGGUUCGAGGUCGGGGACCUGA-5'<br>5'-ATGGAGCCAAGCTCCAGCCCCTGGACT-3' | (SEQ ID NO: 177)<br>(SEQ ID NO: 561)<br>(SEQ ID NO: 945) | |
| AT3-739 Target: | 5'-GAGCCAAGCUCCAGCCCCUGGACtt-3'<br>3'-ACCUCGGUUCGAGGUCGGGGACCUGAA-5'<br>5'-TGGAGCCAAGCTCCAGCCCCTGGACTT-3' | (SEQ ID NO: 178)<br>(SEQ ID NO: 562)<br>(SEQ ID NO: 946) | |
| AT3-740 Target: | 5'-AGCCAAGCUCCAGCCCCUGGACUtc-3'<br>3'-CCUCGGUUCGAGGUCGGGGACCUGAAG-5'<br>5'-GGAGCCAAGCTCCAGCCCCTGGACTTC-3' | (SEQ ID NO: 179)<br>(SEQ ID NO: 563)<br>(SEQ ID NO: 947) | |
| AT3-741 Target: | 5'-GCCAAGCUCCAGCCCCUGGACUUca-3'<br>3'-CUCGGUUCGAGGUCGGGGACCUGAAGU-5'<br>5'-GAGCCAAGCTCCAGCCCCTGGACTTCA-3' | (SEQ ID NO: 180)<br>(SEQ ID NO: 564)<br>(SEQ ID NO: 948) | |
| AT3-742 Target: | 5'-CCAAGCUCCAGCCCCUGGACUUCaa-3'<br>3'-UCGGUUCGAGGUCGGGGACCUGAAGUU-5'<br>5'-AGCCAAGCTCCAGCCCCTGGACTTCAA-3' | (SEQ ID NO: 181)<br>(SEQ ID NO: 565)<br>(SEQ ID NO: 949) | |
| AT3-743 Target: | 5'-CAAGCUCCAGCCCCUGGACUUCAag-3'<br>3'-CGGUUCGAGGUCGGGGACCUGAAGUUC-5'<br>5'-GCCAAGCTCCAGCCCCTGGACTTCAAG-3' | (SEQ ID NO: 182)<br>(SEQ ID NO: 566)<br>(SEQ ID NO: 950) | |
| AT3-744 Target: | 5'-AAGCUCCAGCCCCUGGACUUCAAgg-3'<br>3'-GGUUCGAGGUCGGGGACCUGAAGUUCC-5'<br>5'-CCAAGCTCCAGCCCCTGGACTTCAAGG-3' | (SEQ ID NO: 183)<br>(SEQ ID NO: 567)<br>(SEQ ID NO: 951) | |
| AT3-745 Target: | 5'-AGCUCCAGCCCCUGGACUUCAAGga-3'<br>3'-GUUCGAGGUCGGGGACCUGAAGUUCCU-5'<br>5'-CAAGCTCCAGCCCCTGGACTTCAAGGA-3' | (SEQ ID NO: 184)<br>(SEQ ID NO: 568)<br>(SEQ ID NO: 952) | |
| AT3-746 Target: | 5'-GCUCCAGCCCCUGGACUUCAAGGaa-3'<br>3'-UUCGAGGUCGGGGACCUGAAGUUCCUU-5'<br>5'-AAGCTCCAGCCCCTGGACTTCAAGGAA-3' | (SEQ ID NO: 185)<br>(SEQ ID NO: 569)<br>(SEQ ID NO: 953) | |
| AT3-747 Target: | 5'-CUCCAGCCCCUGGACUUCAAGGAaa-3'<br>3'-UCGAGGUCGGGGACCUGAAGUUCCUUU-5'<br>5'-AGCTCCAGCCCCTGGACTTCAAGGAAA-3' | (SEQ ID NO: 186)<br>(SEQ ID NO: 570)<br>(SEQ ID NO: 954) | |
| AT3-748 Target: | 5'-UCCAGCCCCUGGACUUCAAGGAAaa-3'<br>3'-CGAGGUCGGGGACCUGAAGUUCCUUUU-5'<br>5'-GCTCCAGCCCCTGGACTTCAAGGAAAA-3' | (SEQ ID NO: 187)<br>(SEQ ID NO: 571)<br>(SEQ ID NO: 955) | |
| AT3-749 Target: | 5'-CCAGCCCCUGGACUUCAAGGAAAat-3'<br>3'-GAGGUCGGGGACCUGAAGUUCCUUUUA-5'<br>5'-CTCCAGCCCCTGGACTTCAAGGAAAAT-3' | (SEQ ID NO: 188)<br>(SEQ ID NO: 572)<br>(SEQ ID NO: 956) | |
| AT3-750 Target: | 5'-CAGCCCCUGGACUUCAAGGAAAAtg-3'<br>3'-AGGUCGGGGACCUGAAGUUCCUUUUAC-5'<br>5'-TCCAGCCCCTGGACTTCAAGGAAAATG-3' | (SEQ ID NO: 189)<br>(SEQ ID NO: 573)<br>(SEQ ID NO: 957) | |
| AT3-751 Target: | 5'-AGCCCCUGGACUUCAAGGAAAAUgc-3'<br>3'-GGUCGGGGACCUGAAGUUCCUUUUACG-5'<br>5'-CCAGCCCCTGGACTTCAAGGAAAATGC-3' | (SEQ ID NO: 190)<br>(SEQ ID NO: 574)<br>(SEQ ID NO: 958) | |
| AT3-752 Target: | 5'-GCCCCUGGACUUCAAGGAAAAUGca-3'<br>3'-GUCGGGGACCUGAAGUUCCUUUUACGU-5'<br>5'-CAGCCCCTGGACTTCAAGGAAAATGCA-3' | (SEQ ID NO: 191)<br>(SEQ ID NO: 575)<br>(SEQ ID NO: 959) | |
| AT3-757 Target: | 5'-UGGACUUCAAGGAAAAUGCAGAGca-3'<br>3'-GGACCUGAAGUUCCUUUUACGUCUCGU-5'<br>5'-CCTGGACTTCAAGGAAAATGCAGAGCA-3' | (SEQ ID NO: 192)<br>(SEQ ID NO: 576)<br>(SEQ ID NO: 960) | |
| AT3-758 Target: | 5'-GGACUUCAAGGAAAAUGCAGAGCaa-3'<br>3'-GACCUGAAGUUCCUUUUACGUCUCGUU-5'<br>5'-CTGGACTTCAAGGAAAATGCAGAGCAA-3' | (SEQ ID NO: 193)<br>(SEQ ID NO: 577)<br>(SEQ ID NO: 961) | |

TABLE 2-continued

Selected Human Anti-AT3 DsiRNA Agents (Asymmetrics)

| | | |
|---|---|---|
| AT3-759 Target: | 5'-GACUUCAAGGAAAAUGCAGAGCAat-3'<br>3'-ACCUGAAGUUCCUUUUACGUCUCGUUA-5'<br>5'-TGGACTTCAAGGAAAATGCAGAGCAAT-3' | (SEQ ID NO: 194)<br>(SEQ ID NO: 578)<br>(SEQ ID NO: 962) |
| AT3-760 Target: | 5'-ACUUCAAGGAAAAUGCAGAGCAAtc-3'<br>3'-CCUGAAGUUCCUUUUACGUCUCGUUAG-5'<br>5'-GGACTTCAAGGAAAATGCAGAGCAATC-3' | (SEQ ID NO: 195)<br>(SEQ ID NO: 579)<br>(SEQ ID NO: 963) |
| AT3-762 Target: | 5'-UUCAAGGAAAAUGCAGAGCAAUCca-3'<br>3'-UGAAGUUCCUUUUACGUCUCGUUAGGU-5'<br>5'-ACTTCAAGGAAAATGCAGAGCAATCCA-3' | (SEQ ID NO: 196)<br>(SEQ ID NO: 580)<br>(SEQ ID NO: 964) |
| AT3-763 Target: | 5'-UCAAGGAAAAUGCAGAGCAAUCCag-3'<br>3'-GAAGUUCCUUUUACGUCUCGUUAGGUC-5'<br>5'-CTTCAAGGAAAATGCAGAGCAATCCAG-3' | (SEQ ID NO: 197)<br>(SEQ ID NO: 581)<br>(SEQ ID NO: 965) |
| AT3-764 Target: | 5'-CAAGGAAAAUGCAGAGCAAUCCAga-3'<br>3'-AAGUUCCUUUUACGUCUCGUUAGGUCU-5'<br>5'-TTCAAGGAAAATGCAGAGCAATCCAGA-3' | (SEQ ID NO: 198)<br>(SEQ ID NO: 582)<br>(SEQ ID NO: 966) |
| AT3-765 Target: | 5'-AAGGAAAAUGCAGAGCAAUCCAGag-3'<br>3'-AGUUCCUUUUACGUCUCGUUAGGUCUC-5'<br>5'-TCAAGGAAAATGCAGAGCAATCCAGAG-3' | (SEQ ID NO: 199)<br>(SEQ ID NO: 583)<br>(SEQ ID NO: 967) |
| AT3-794 Target: | 5'-CAUCAACAAAUGGGUGUCCAUAag-3'<br>3'-CGGUAGUUGUUUACCCACAGGUUAUUC-5'<br>5'-GCCATCAACAAATGGGTGTCCAATAAG-3' | (SEQ ID NO: 200)<br>(SEQ ID NO: 584)<br>(SEQ ID NO: 968) |
| AT3-795 Target: | 5'-AUCAACAAAUGGGUGUCCAUAAga-3'<br>3'-GGUAGUUGUUUACCCACAGGUUAUUCU-5'<br>5'-CCATCAACAAATGGGTGTCCAATAAGA-3' | (SEQ ID NO: 201)<br>(SEQ ID NO: 585)<br>(SEQ ID NO: 969) |
| AT3-800 Target: | 5'-CAAAUGGGUGUCCAAUAAGACCGaa-3'<br>3'-UUGUUUACCCACAGGUUAUUCUGGCUU-5'<br>5'-AACAAATGGGTGTCCAATAAGACCGAA-3' | (SEQ ID NO: 202)<br>(SEQ ID NO: 586)<br>(SEQ ID NO: 970) |
| AT3-864 Target: | 5'-GAGCUCACUGUUCUGGUGCUGGUta-3'<br>3'-UACUCGAGUGACAAGACCACGACCAAU-5'<br>5'-ATGAGCTCACTGTTCTGGTGCTGGTTA-3' | (SEQ ID NO: 203)<br>(SEQ ID NO: 587)<br>(SEQ ID NO: 971) |
| AT3-866 Target: | 5'-GCUCACUGUUCUGGUGCUGGUUAac-3'<br>3'-CUCGAGUGACAAGACCACGACCAAUUG-5'<br>5'-GAGCTCACTGTTCTGGTGCTGGTTAAC-3' | (SEQ ID NO: 204)<br>(SEQ ID NO: 588)<br>(SEQ ID NO: 972) |
| AT3-867 Target: | 5'-CUCACUGUUCUGGUGCUGGUUAAca-3'<br>3'-UCGAGUGACAAGACCACGACCAAUUGU-5'<br>5'-AGCTCACTGTTCTGGTGCTGGTTAACA-3' | (SEQ ID NO: 205)<br>(SEQ ID NO: 589)<br>(SEQ ID NO: 973) |
| AT3-868 Target: | 5'-UCACUGUUCUGGUGCUGGUUAACac-3'<br>3'-CGAGUGACAAGACCACGACCAAUUGUG-5'<br>5'-GCTCACTGTTCTGGTGCTGGTTAACAC-3' | (SEQ ID NO: 206)<br>(SEQ ID NO: 590)<br>(SEQ ID NO: 974) |
| AT3-869 Target: | 5'-CACUGUUCUGGUGCUGGUUAACAcc-3'<br>3'-GAGUGACAAGACCACGACCAAUUGUGG-5'<br>5'-CTCACTGTTCTGGTGCTGGTTAACACC-3' | (SEQ ID NO: 207)<br>(SEQ ID NO: 591)<br>(SEQ ID NO: 975) |
| AT3-870 Target: | 5'-ACUGUUCUGGUGCUGGUUAACACca-3'<br>3'-AGUGACAAGACCACGACCAAUUGUGGU-5'<br>5'-TCACTGTTCTGGTGCTGGTTAACACCA-3' | (SEQ ID NO: 208)<br>(SEQ ID NO: 592)<br>(SEQ ID NO: 976) |
| AT3-871 Target: | 5'-CUGUUCUGGUGCUGGUUAACACCat-3'<br>3'-GUGACAAGACCACGACCAAUUGUGGUA-5'<br>5'-CACTGTTCTGGTGCTGGTTAACACCAT-3' | (SEQ ID NO: 209)<br>(SEQ ID NO: 593)<br>(SEQ ID NO: 977) |
| AT3-872 Target: | 5'-UGUUCUGGUGCUGGUUAACACCAtt-3'<br>3'-UGACAAGACCACGACCAAUUGUGGUAA-5'<br>5'-ACTGTTCTGGTGCTGGTTAACACCATT-3' | (SEQ ID NO: 210)<br>(SEQ ID NO: 594)<br>(SEQ ID NO: 978) |
| AT3-873 Target: | 5'-GUUCUGGUGCUGGUUAACACCAUtt-3'<br>3'-GACAAGACCACGACCAAUUGUGGUAAA-5'<br>5'-CTGTTCTGGTGCTGGTTAACACCATTT-3' | (SEQ ID NO: 211)<br>(SEQ ID NO: 595)<br>(SEQ ID NO: 979) |
| AT3-874 Target: | 5'-UUCUGGUGCUGGUUAACACCAUUta-3'<br>3'-ACAAGACCACGACCAAUUGUGGUAAAU-5'<br>5'-TGTTCTGGTGCTGGTTAACACCATTTA-3' | (SEQ ID NO: 212)<br>(SEQ ID NO: 596)<br>(SEQ ID NO: 980) |

TABLE 2-continued

Selected Human Anti-AT3 DsiRNA Agents (Asymmetrics)

```
                5'-UCUGGUGCUGGUUAACACCAUUUac-3'      (SEQ ID NO: 213)
                3'-CAAGACCACGACCAAUUGUGGUAAAUG-5'    (SEQ ID NO: 597)
AT3-875 Target: 5'-GTTCTGGTGCTGGTTAACACCATTTAC-3'    (SEQ ID NO: 981)

5'-CUGGUGCUGGUUAACACCAUUUAct-3'      (SEQ ID NO: 214)
                3'-AAGACCACGACCAAUUGUGGUAAAUGA-5'    (SEQ ID NO: 598)
AT3-876 Target: 5'-TTCTGGTGCTGGTTAACACCATTTACT-3'    (SEQ ID NO: 982)

5'-UGGUGCUGGUUAACACCAUUUACtt-3'      (SEQ ID NO: 215)
                3'-AGACCACGACCAAUUGUGGUAAAUGAA-5'    (SEQ ID NO: 599)
AT3-877 Target: 5'-TCTGGTGCTGGTTAACACCATTTACTT-3'    (SEQ ID NO: 983)

5'-GGUGCUGGUUAACACCAUUUACUtc-3'      (SEQ ID NO: 216)
                3'-GACCACGACCAAUUGUGGUAAAUGAAG-5'    (SEQ ID NO: 600)
AT3-878 Target: 5'-CTGGTGCTGGTTAACACCATTTACTTC-3'    (SEQ ID NO: 984)

5'-GUGCUGGUUAACACCAUUUACUUca-3'      (SEQ ID NO: 217)
                3'-ACCACGACCAAUUGUGGUAAAUGAAGU-5'    (SEQ ID NO: 601)
AT3-879 Target: 5'-TGGTGCTGGTTAACACCATTTACTTCA-3'    (SEQ ID NO: 985)

5'-UGCUGGUUAACACCAUUUACUUCaa-3'      (SEQ ID NO: 218)
                3'-CCACGACCAAUUGUGGUAAAUGAAGUU-5'    (SEQ ID NO: 602)
AT3-880 Target: 5'-GGTGCTGGTTAACACCATTTACTTCAA-3'    (SEQ ID NO: 986)

5'-GCUGGUUAACACCAUUUACUUCAag-3'      (SEQ ID NO: 219)
                3'-CACGACCAAUUGUGGUAAAUGAAGUUC-5'    (SEQ ID NO: 603)
AT3-881 Target: 5'-GTGCTGGTTAACACCATTTACTTCAAG-3'    (SEQ ID NO: 987)

5'-CUGGUUAACACCAUUUACUUCAAgg-3'      (SEQ ID NO: 220)
                3'-ACGACCAAUUGUGGUAAAUGAAGUUCC-5'    (SEQ ID NO: 604)
AT3-882 Target: 5'-TGCTGGTTAACACCATTTACTTCAAGG-3'    (SEQ ID NO: 988)

5'-UGGUUAACACCAUUUACUUCAAGgg-3'      (SEQ ID NO: 221)
                3'-CGACCAAUUGUGGUAAAUGAAGUUCCC-5'    (SEQ ID NO: 605)
AT3-883 Target: 5'-GCTGGTTAACACCATTTACTTCAAGGG-3'    (SEQ ID NO: 989)

5'-GGUUAACACCAUUUACUUCAAGGgc-3'      (SEQ ID NO: 222)
                3'-GACCAAUUGUGGUAAAUGAAGUUCCCG-5'    (SEQ ID NO: 606)
AT3-884 Target: 5'-CTGGTTAACACCATTTACTTCAAGGGC-3'    (SEQ ID NO: 990)

5'-GUUAACACCAUUUACUUCAAGGGcc-3'      (SEQ ID NO: 223)
                3'-ACCAAUUGUGGUAAAUGAAGUUCCCGG-5'    (SEQ ID NO: 607)
AT3-885 Target: 5'-TGGTTAACACCATTTACTTCAAGGGCC-3'    (SEQ ID NO: 991)

5'-UUAACACCAUUUACUUCAAGGGCct-3'      (SEQ ID NO: 224)
                3'-CCAAUUGUGGUAAAUGAAGUUCCCGGA-5'    (SEQ ID NO: 608)
AT3-886 Target: 5'-GGTTAACACCATTTACTTCAAGGGCCT-3'    (SEQ ID NO: 992)

5'-UAACACCAUUUACUUCAAGGGCCtg-3'      (SEQ ID NO: 225)
                3'-CAAUUGUGGUAAAUGAAGUUCCCGGAC-5'    (SEQ ID NO: 609)
AT3-887 Target: 5'-GTTAACACCATTTACTTCAAGGGCCTG-3'    (SEQ ID NO: 993)

5'-AACACCAUUUACUUCAAGGGCCUgt-3'      (SEQ ID NO: 226)
                3'-AAUUGUGGUAAAUGAAGUUCCCGGACA-5'    (SEQ ID NO: 610)
AT3-888 Target: 5'-TTAACACCATTTACTTCAAGGGCCTGT-3'    (SEQ ID NO: 994)

5'-ACACCAUUUACUUCAAGGGCCUGtg-3'      (SEQ ID NO: 227)
                3'-AUUGUGGUAAAUGAAGUUCCCGGACAC-5'    (SEQ ID NO: 611)
AT3-889 Target: 5'-TAACACCATTTACTTCAAGGGCCTGTG-3'    (SEQ ID NO: 995)

5'-CACCAUUUACUUCAAGGGCCUGUgg-3'      (SEQ ID NO: 228)
                3'-UUGUGGUAAAUGAAGUUCCCGGACACC-5'    (SEQ ID NO: 612)
AT3-890 Target: 5'-AACACCATTTACTTCAAGGGCCTGTGG-3'    (SEQ ID NO: 996)

5'-ACCAUUUACUUCAAGGGCCUGUGga-3'      (SEQ ID NO: 229)
                3'-UGUGGUAAAUGAAGUUCCCGGACACCU-5'    (SEQ ID NO: 613)
AT3-891 Target: 5'-ACACCATTTACTTCAAGGGCCTGTGGA-3'    (SEQ ID NO: 997)

5'-CCAUUUACUUCAAGGGCCUGUGGaa-3'      (SEQ ID NO: 230)
                3'-GUGGUAAAUGAAGUUCCCGGACACCUU-5'    (SEQ ID NO: 614)
AT3-892 Target: 5'-CACCATTTACTTCAAGGGCCTGTGGAA-3'    (SEQ ID NO: 998)

5'-CAUUUACUUCAAGGGCCUGUGGAag-3'      (SEQ ID NO: 231)
                3'-UGGUAAAUGAAGUUCCCGGACACCUUC-5'    (SEQ ID NO: 615)
AT3-893 Target: 5'-ACCATTTACTTCAAGGGCCTGTGGAAG-3'    (SEQ ID NO: 999)
```

TABLE 2-continued

Selected Human Anti-AT3 DsiRNA Agents (Asymmetrics)

| | | |
|---|---|---|
| AT3-894 Target: | 5'-AUUUACUUCAAGGGCCUGUGGAAGt-3'<br>3'-GGUAAAUGAAGUUCCCGGACACCUUCA-5'<br>5'-CCATTTACTTCAAGGGCCTGTGGAAGT-3' | (SEQ ID NO: 232)<br>(SEQ ID NO: 616)<br>(SEQ ID NO: 1000) |
| AT3-895 Target: | 5'-UUUACUUCAAGGGCCUGUGGAAGtc-3'<br>3'-GUAAAUGAAGUUCCCGGACACCUUCAG-5'<br>5'-CATTTACTTCAAGGGCCTGTGGAAGTC-3' | (SEQ ID NO: 233)<br>(SEQ ID NO: 617)<br>(SEQ ID NO: 1001) |
| AT3-896 Target: | 5'-UUACUUCAAGGGCCUGUGGAAGUca-3'<br>3'-UAAAUGAAGUUCCCGGACACCUUCAGU-5'<br>5'-ATTTACTTCAAGGGCCTGTGGAAGTCA-3' | (SEQ ID NO: 234)<br>(SEQ ID NO: 618)<br>(SEQ ID NO: 1002) |
| AT3-897 Target: | 5'-UACUUCAAGGGCCUGUGGAAGUCaa-3'<br>3'-AAAUGAAGUUCCCGGACACCUUCAGUU-5'<br>5'-TTTACTTCAAGGGCCTGTGGAAGTCAA-3' | (SEQ ID NO: 235)<br>(SEQ ID NO: 619)<br>(SEQ ID NO: 1003) |
| AT3-898 Target: | 5'-ACUUCAAGGGCCUGUGGAAGUCAaa-3'<br>3'-AAUGAAGUUCCCGGACACCUUCAGUUU-5'<br>5'-TTACTTCAAGGGCCTGTGGAAGTCAAA-3' | (SEQ ID NO: 236)<br>(SEQ ID NO: 620)<br>(SEQ ID NO: 1004) |
| AT3-899 Target: | 5'-CUUCAAGGGCCUGUGGAAGUCAAag-3'<br>3'-AUGAAGUUCCCGGACACCUUCAGUUUC-5'<br>5'-TACTTCAAGGGCCTGTGGAAGTCAAAG-3' | (SEQ ID NO: 237)<br>(SEQ ID NO: 621)<br>(SEQ ID NO: 1005) |
| AT3-900 Target: | 5'-UUCAAGGGCCUGUGGAAGUCAAAgt-3'<br>3'-UGAAGUUCCCGGACACCUUCAGUUUCA-5'<br>5'-ACTTCAAGGGCCTGTGGAAGTCAAAGT-3' | (SEQ ID NO: 238)<br>(SEQ ID NO: 622)<br>(SEQ ID NO: 1006) |
| AT3-901 Target: | 5'-UCAAGGGCCUGUGGAAGUCAAAGtt-3'<br>3'-GAAGUUCCCGGACACCUUCAGUUUCAA-5'<br>5'-CTTCAAGGGCCTGTGGAAGTCAAAGTT-3' | (SEQ ID NO: 239)<br>(SEQ ID NO: 623)<br>(SEQ ID NO: 1007) |
| AT3-902 Target: | 5'-CAAGGGCCUGUGGAAGUCAAAGUtc-3'<br>3'-AAGUUCCCGGACACCUUCAGUUUCAAG-5'<br>5'-TTCAAGGGCCTGTGGAAGTCAAAGTTC-3' | (SEQ ID NO: 240)<br>(SEQ ID NO: 624)<br>(SEQ ID NO: 1008) |
| AT3-903 Target: | 5'-AAGGGCCUGUGGAAGUCAAAGUUca-3'<br>3'-AGUUCCCGGACACCUUCAGUUUCAAGU-5'<br>5'-TCAAGGGCCTGTGGAAGTCAAAGTTCA-3' | (SEQ ID NO: 241)<br>(SEQ ID NO: 625)<br>(SEQ ID NO: 1009) |
| AT3-904 Target: | 5'-AGGGCCUGUGGAAGUCAAAGUUCag-3'<br>3'-GUUCCCGGACACCUUCAGUUUCAAGUC-5'<br>5'-CAAGGGCCTGTGGAAGTCAAAGTTCAG-3' | (SEQ ID NO: 242)<br>(SEQ ID NO: 626)<br>(SEQ ID NO: 1010) |
| AT3-905 Target: | 5'-GGGCCUGUGGAAGUCAAAGUUCAgc-3'<br>3'-UUCCCGGACACCUUCAGUUUCAAGUCG-5'<br>5'-AAGGGCCTGTGGAAGTCAAAGTTCAGC-3' | (SEQ ID NO: 243)<br>(SEQ ID NO: 627)<br>(SEQ ID NO: 1011) |
| AT3-906 Target: | 5'-GGCCUGUGGAAGUCAAAGUUCAGcc-3'<br>3'-UCCCGGACACCUUCAGUUUCAAGUCGG-5'<br>5'-AGGGCCTGTGGAAGTCAAAGTTCAGCC-3' | (SEQ ID NO: 244)<br>(SEQ ID NO: 628)<br>(SEQ ID NO: 1012) |
| AT3-907 Target: | 5'-GCCUGUGGAAGUCAAAGUUCAGCcc-3'<br>3'-CCCGGACACCUUCAGUUUCAAGUCGGG-5'<br>5'-GGGCCTGTGGAAGTCAAAGTTCAGCCC-3' | (SEQ ID NO: 245)<br>(SEQ ID NO: 629)<br>(SEQ ID NO: 1013) |
| AT3-908 Target: | 5'-CCUGUGGAAGUCAAAGUUCAGCCct-3'<br>3'-CCGGACACCUUCAGUUUCAAGUCGGGA-5'<br>5'-GGCCTGTGGAAGTCAAAGTTCAGCCCT-3' | (SEQ ID NO: 246)<br>(SEQ ID NO: 630)<br>(SEQ ID NO: 1014) |
| AT3-909 Target: | 5'-CUGUGGAAGUCAAAGUUCAGCCCtg-3'<br>3'-CGGACACCUUCAGUUUCAAGUCGGGAC-5'<br>5'-GCCTGTGGAAGTCAAAGTTCAGCCCTG-3' | (SEQ ID NO: 247)<br>(SEQ ID NO: 631)<br>(SEQ ID NO: 1015) |
| AT3-910 Target: | 5'-UGUGGAAGUCAAAGUUCAGCCCUga-3'<br>3'-GGACACCUUCAGUUUCAAGUCGGGACU-5'<br>5'-CCTGTGGAAGTCAAAGTTCAGCCCTGA-3' | (SEQ ID NO: 248)<br>(SEQ ID NO: 632)<br>(SEQ ID NO: 1016) |
| AT3-911 Target: | 5'-GUGGAAGUCAAAGUUCAGCCCUGag-3'<br>3'-GACACCUUCAGUUUCAAGUCGGGACUC-5'<br>5'-CTGTGGAAGTCAAAGTTCAGCCCTGAG-3' | (SEQ ID NO: 249)<br>(SEQ ID NO: 633)<br>(SEQ ID NO: 1017) |
| AT3-912 Target: | 5'-UGGAAGUCAAAGUUCAGCCCUGAga-3'<br>3'-ACACCUUCAGUUUCAAGUCGGGACUCU-5'<br>5'-TGTGGAAGTCAAAGTTCAGCCCTGAGA-3' | (SEQ ID NO: 250)<br>(SEQ ID NO: 634)<br>(SEQ ID NO: 1018) |

TABLE 2-continued

Selected Human Anti-AT3 DsiRNA Agents (Asymmetrics)

|   |   |   |
|---|---|---|
| AT3-913 Target: | 5'-GGAAGUCAAAGUUCAGCCCUGAGaa-3'<br>3'-CACCUUCAGUUUCAAGUCGGGACUCUU-5'<br>5'-GTGGAAGTCAAAGTTCAGCCCTGAGAA-3' | (SEQ ID NO: 251)<br>(SEQ ID NO: 635)<br>(SEQ ID NO: 1019) |
| AT3-914 Target: | 5'-GAAGUCAAAGUUCAGCCCUGAGAac-3'<br>3'-ACCUUCAGUUUCAAGUCGGGACUCUUG-5'<br>5'-TGGAAGTCAAAGTTCAGCCCTGAGAAC-3' | (SEQ ID NO: 252)<br>(SEQ ID NO: 636)<br>(SEQ ID NO: 1020) |
| AT3-915 Target: | 5'-AAGUCAAAGUUCAGCCCUGAGAAca-3'<br>3'-CCUUCAGUUUCAAGUCGGGACUCUUGU-5'<br>5'-GGAAGTCAAAGTTCAGCCCTGAGAACA-3' | (SEQ ID NO: 253)<br>(SEQ ID NO: 637)<br>(SEQ ID NO: 1021) |
| AT3-916 Target: | 5'-AGUCAAAGUUCAGCCCUGAGAACac-3'<br>3'-CUUCAGUUUCAAGUCGGGACUCUUGUG-5'<br>5'-GAAGTCAAAGTTCAGCCCTGAGAACAC-3' | (SEQ ID NO: 254)<br>(SEQ ID NO: 638)<br>(SEQ ID NO: 1022) |
| AT3-959 Target: | 5'-CAAGGCUGAUGGAGAGUCGUGUUca-3'<br>3'-AUGUUCCGACUACCUCUCAGCACAAGU-5'<br>5'-TACAAGGCTGATGGAGAGTCGTGTTCA-3' | (SEQ ID NO: 255)<br>(SEQ ID NO: 639)<br>(SEQ ID NO: 1023) |
| AT3-966 Target: | 5'-GAUGGAGAGUCGUGUUCAGCAUCta-3'<br>3'-GACUACCUCUCAGCACAAGUCGUAGAU-5'<br>5'-CTGATGGAGAGTCGTGTTCAGCATCTA-3' | (SEQ ID NO: 256)<br>(SEQ ID NO: 640)<br>(SEQ ID NO: 1024) |
| AT3-967 Target: | 5'-AUGGAGAGUCGUGUUCAGCAUCUat-3'<br>3'-ACUACCUCUCAGCACAAGUCGUAGAUA-5'<br>5'-TGATGGAGAGTCGTGTTCAGCATCTAT-3' | (SEQ ID NO: 257)<br>(SEQ ID NO: 641)<br>(SEQ ID NO: 1025) |
| AT3-988 Target: | 5'-CUAUGAUGUACCAGGAAGGCAAGtt-3'<br>3'-UAGAUACUACAUGGUCCUUCCGUUCAA-5'<br>5'-ATCTATGATGTACCAGGAAGGCAAGTT-3' | (SEQ ID NO: 258)<br>(SEQ ID NO: 642)<br>(SEQ ID NO: 1026) |
| AT3-989 Target: | 5'-UAUGAUGUACCAGGAAGGCAAGUtc-3'<br>3'-AGAUACUACAUGGUCCUUCCGUUCAAG-5'<br>5'-TCTATGATGTACCAGGAAGGCAAGTTC-3' | (SEQ ID NO: 259)<br>(SEQ ID NO: 643)<br>(SEQ ID NO: 1027) |
| AT3-990 Target: | 5'-AUGAUGUACCAGGAAGGCAAGUUcc-3'<br>3'-GAUACUACAUGGUCCUUCCGUUCAAGG-5'<br>5'-CTATGATGTACCAGGAAGGCAAGTTCC-3' | (SEQ ID NO: 260)<br>(SEQ ID NO: 644)<br>(SEQ ID NO: 1028) |
| AT3-991 Target: | 5'-UGAUGUACCAGGAAGGCAAGUUCcg-3'<br>3'-AUACUACAUGGUCCUUCCGUUCAAGGC-5'<br>5'-TATGATGTACCAGGAAGGCAAGTTCCG-3' | (SEQ ID NO: 261)<br>(SEQ ID NO: 645)<br>(SEQ ID NO: 1029) |
| AT3-993 Target: | 5'-AUGUACCAGGAAGGCAAGUUCCGtt-3'<br>3'-ACUACAUGGUCCUUCCGUUCAAGGCAA-5'<br>5'-TGATGTACCAGGAAGGCAAGTTCCGTT-3' | (SEQ ID NO: 262)<br>(SEQ ID NO: 646)<br>(SEQ ID NO: 1030) |
| AT3-1040 Target: | 5'-CCAGGUGCUUGAGUUGCCCUUCAaa-3'<br>3'-UGGGUCCACGAACUCAACGGGAAGUUU-5'<br>5'-ACCCAGGTGCTTGAGTTGCCCTTCAAA-3' | (SEQ ID NO: 263)<br>(SEQ ID NO: 647)<br>(SEQ ID NO: 1031) |
| AT3-1043 Target: | 5'-GGUGCUUGAGUUGCCCUUCAAAGgt-3'<br>3'-GUCCACGAACUCAACGGGAAGUUUCCA-5'<br>5'-CAGGTGCTTGAGTTGCCCTTCAAAGGT-3' | (SEQ ID NO: 264)<br>(SEQ ID NO: 648)<br>(SEQ ID NO: 1032) |
| AT3-1044 Target: | 5'-GUGCUUGAGUUGCCCUUCAAAGGtg-3'<br>3'-UCCACGAACUCAACGGGAAGUUUCCAC-5'<br>5'-AGGTGCTTGAGTTGCCCTTCAAAGGTG-3' | (SEQ ID NO: 265)<br>(SEQ ID NO: 649)<br>(SEQ ID NO: 1033) |
| AT3-1045 Target: | 5'-UGCUUGAGUUGCCCUUCAAAGGUga-3'<br>3'-CCACGAACUCAACGGGAAGUUUCCACU-5'<br>5'-GGTGCTTGAGTTGCCCTTCAAAGGTGA-3' | (SEQ ID NO: 266)<br>(SEQ ID NO: 650)<br>(SEQ ID NO: 1034) |
| AT3-1065 Target: | 5'-GGUGAUGACAUCACCAUGGUCCUca-3'<br>3'-UUCCACUACUGUAGUGGUACCAGGAGU-5'<br>5'-AAGGTGATGACATCACCATGGTCCTCA-3' | (SEQ ID NO: 267)<br>(SEQ ID NO: 651)<br>(SEQ ID NO: 1035) |
| AT3-1066 Target: | 5'-GUGAUGACAUCACCAUGGUCCUCat-3'<br>3'-UCCACUACUGUAGUGGUACCAGGAGUA-5'<br>5'-AGGTGATGACATCACCATGGTCCTCAT-3' | (SEQ ID NO: 268)<br>(SEQ ID NO: 652)<br>(SEQ ID NO: 1036) |
| AT3-1093 Target: | 5'-UGCCCAAGCCUGAGAAGAGCCUGgc-3'<br>3'-GAACGGGUUCGGACUCUUCUCGGACCG-5'<br>5'-CTTGCCCAAGCCTGAGAAGAGCCTGGC-3' | (SEQ ID NO: 269)<br>(SEQ ID NO: 653)<br>(SEQ ID NO: 1037) |

TABLE 2-continued

Selected Human Anti-AT3 DsiRNA Agents (Asymmetrics)

```
                  5'-GCCCAAGCUGAGAAGAGCCUGGcc-3'          (SEQ ID NO: 270)
                  3'-AACGGGUUCGGACUCUUCUCGGACCGG-5'       (SEQ ID NO: 654)
AT3-1094 Target:  5'-TTGCCCAAGCCTGAGAAGAGCCTGGCC-3'       (SEQ ID NO: 1038)

5'-CCCAAGCCUGAGAAGAGCCUGGCca-3'         (SEQ ID NO: 271)
                  3'-ACGGGUUCGGACUCUUCUCGGACCGGU-5'       (SEQ ID NO: 655)
AT3-1095 Target:  5'-TGCCCAAGCCTGAGAAGAGCCTGGCCA-3'       (SEQ ID NO: 1039)

5'-CCAAGCCUGAGAAGAGCCUGGCCaa-3'         (SEQ ID NO: 272)
                  3'-CGGGUUCGGACUCUUCUCGGACCGGUU-5'       (SEQ ID NO: 656)
AT3-1096 Target:  5'-GCCCAAGCCTGAGAAGAGCCTGGCCAA-3'       (SEQ ID NO: 1040)

5'-CAAGCCUGAGAAGAGCCUGGCCAag-3'         (SEQ ID NO: 273)
                  3'-GGGUUCGGACUCUUCUCGGACCGGUUC-5'       (SEQ ID NO: 657)
AT3-1097 Target:  5'-CCCAAGCCTGAGAAGAGCCTGGCCAAG-3'       (SEQ ID NO: 1041)

5'-AAGCCUGAGAAGAGCCUGGCCAAgg-3'         (SEQ ID NO: 274)
                  3'-GGUUCGGACUCUUCUCGGACCGGUUCC-5'       (SEQ ID NO: 658)
AT3-1098 Target:  5'-CCAAGCCTGAGAAGAGCCTGGCCAAGG-3'       (SEQ ID NO: 1042)

5'-AGCCUGAGAAGAGCCUGGCCAAGgt-3'         (SEQ ID NO: 275)
                  3'-GUUCGGACUCUUCUCGGACCGGUUCCA-5'       (SEQ ID NO: 659)
AT3-1099 Target:  5'-CAAGCCTGAGAAGAGCCTGGCCAAGGT-3'       (SEQ ID NO: 1043)

5'-GCCUGAGAAGAGCCUGGCCAAGGta-3'         (SEQ ID NO: 276)
                  3'-UUCGGACUCUUCUCGGACCGGUUCCAU-5'       (SEQ ID NO: 660)
AT3-1100 Target:  5'-AAGCCTGAGAAGAGCCTGGCCAAGGTA-3'       (SEQ ID NO: 1044)

5'-CCUGAGAAGAGCCUGGCCAAGGUag-3'         (SEQ ID NO: 277)
                  3'-UCGGACUCUUCUCGGACCGGUUCCAUC-5'       (SEQ ID NO: 661)
AT3-1101 Target:  5'-AGCCTGAGAAGAGCCTGGCCAAGGTAG-3'       (SEQ ID NO: 1045)

5'-CUGAGAAGAGCCUGGCCAAGGUAga-3'         (SEQ ID NO: 278)
                  3'-CGGACUCUUCUCGGACCGGUUCCAUCU-5'       (SEQ ID NO: 662)
AT3-1102 Target:  5'-GCCTGAGAAGAGCCTGGCCAAGGTAGA-3'       (SEQ ID NO: 1046)

5'-UGAGAAGAGCCUGGCCAAGGUAGag-3'         (SEQ ID NO: 279)
                  3'-GGACUCUUCUCGGACCGGUUCCAUCUC-5'       (SEQ ID NO: 663)
AT3-1103 Target:  5'-CCTGAGAAGAGCCTGGCCAAGGTAGAG-3'       (SEQ ID NO: 1047)

5'-GAGAAGAGCCUGGCCAAGGUAGAga-3'         (SEQ ID NO: 280)
                  3'-GACUCUUCUCGGACCGGUUCCAUCUCU-5'       (SEQ ID NO: 664)
AT3-1104 Target:  5'-CTGAGAAGAGCCTGGCCAAGGTAGAGA-3'       (SEQ ID NO: 1048)

5'-AGAAGAGCCUGGCCAAGGUAGAGaa-3'         (SEQ ID NO: 281)
                  3'-ACUCUUCUCGGACCGGUUCCAUCUCUU-5'       (SEQ ID NO: 665)
AT3-1105 Target:  5'-TGAGAAGAGCCTGGCCAAGGTAGAGAA-3'       (SEQ ID NO: 1049)

5'-GUGGUCCACAUGCCCCGCUUCCGca-3'         (SEQ ID NO: 282)
                  3'-ACCACCAGGUGUACGGGGCGAAGGCGU-5'       (SEQ ID NO: 666)
AT3-1188 Target:  5'-TGGTGGTCCACATGCCCCGCTTCCGCA-3'       (SEQ ID NO: 1050)

5'-UGGUCCACAUGCCCCGCUUCCGCat-3'         (SEQ ID NO: 283)
                  3'-CCACCAGGUGUACGGGGCGAAGGCGUA-5'       (SEQ ID NO: 667)
AT3-1189 Target:  5'-GGTGGTCCACATGCCCCGCTTCCGCAT-3'       (SEQ ID NO: 1051)

5'-GGUCCACAUGCCCCGCUUCCGCAtt-3'         (SEQ ID NO: 284)
                  3'-CACCAGGUGUACGGGGCGAAGGCGUAA-5'       (SEQ ID NO: 668)
AT3-1190 Target:  5'-GTGGTCCACATGCCCCGCTTCCGCATT-3'       (SEQ ID NO: 1052)

5'-GUCCACAUGCCCCGCUUCCGCAUtg-3'         (SEQ ID NO: 285)
                  3'-ACCAGGUGUACGGGGCGAAGGCGUAAC-5'       (SEQ ID NO: 669)
AT3-1191 Target:  5'-TGGTCCACATGCCCCGCTTCCGCATTG-3'       (SEQ ID NO: 1053)

5'-UCCACAUGCCCCGCUUCCGCAUUga-3'         (SEQ ID NO: 286)
                  3'-CCAGGUGUACGGGGCGAAGGCGUAACU-5'       (SEQ ID NO: 670)
AT3-1192 Target:  5'-GGTCCACATGCCCCGCTTCCGCATTGA-3'       (SEQ ID NO: 1054)

5'-CCACAUGCCCCGCUUCCGCAUUGag-3'         (SEQ ID NO: 287)
                  3'-CAGGUGUACGGGGCGAAGGCGUAACUC-5'       (SEQ ID NO: 671)
AT3-1193 Target:  5'-GTCCACATGCCCCGCTTCCGCATTGAG-3'       (SEQ ID NO: 1055)

5'-CACAUGCCCCGCUUCCGCAUUGAgg-3'         (SEQ ID NO: 288)
                  3'-AGGUGUACGGGGCGAAGGCGUAACUCC-5'       (SEQ ID NO: 672)
AT3-1194 Target:  5'-TCCACATGCCCCGCTTCCGCATTGAGG-3'       (SEQ ID NO: 1056)
```

TABLE 2-continued

Selected Human Anti-AT3 DsiRNA Agents (Asymmetrics)

|  |  |  |  |
|---|---|---|---|
| AT3-1227 | Target: | 5'-AGUUUGAAGGAGCAGCUGCAAGACa-3'<br>3'-AGUCAAACUUCCUCGUCGACGUUCUGU-5'<br>5'-TCAGTTTGAAGGAGCAGCTGCAAGACA-3' | (SEQ ID NO: 289)<br>(SEQ ID NO: 673)<br>(SEQ ID NO: 1057) |
| AT3-1228 | Target: | 5'-GUUUGAAGGAGCAGCUGCAAGACat-3'<br>3'-GUCAAACUUCCUCGUCGACGUUCUGUA-5'<br>5'-CAGTTTGAAGGAGCAGCTGCAAGACAT-3' | (SEQ ID NO: 290)<br>(SEQ ID NO: 674)<br>(SEQ ID NO: 1058) |
| AT3-1231 | Target: | 5'-UGAAGGAGCAGCUGCAAGACAUGgg-3'<br>3'-AAACUUCCUCGUCGACGUUCUGUACCC-5'<br>5'-TTTGAAGGAGCAGCTGCAAGACATGGG-3' | (SEQ ID NO: 291)<br>(SEQ ID NO: 675)<br>(SEQ ID NO: 1059) |
| AT3-1232 | Target: | 5'-GAAGGAGCAGCUGCAAGACAUGGgc-3'<br>3'-AACUUCCUCGUCGACGUUCUGUACCCG-5'<br>5'-TTGAAGGAGCAGCTGCAAGACATGGGC-3' | (SEQ ID NO: 292)<br>(SEQ ID NO: 676)<br>(SEQ ID NO: 1060) |
| AT3-1233 | Target: | 5'-AAGGAGCAGCUGCAAGACAUGGGcc-3'<br>3'-ACUUCCUCGUCGACGUUCUGUACCCGG-5'<br>5'-TGAAGGAGCAGCTGCAAGACATGGGCC-3' | (SEQ ID NO: 293)<br>(SEQ ID NO: 677)<br>(SEQ ID NO: 1061) |
| AT3-1234 | Target: | 5'-AGGAGCAGCUGCAAGACAUGGGCct-3'<br>3'-CUUCCUCGUCGACGUUCUGUACCCGGA-5'<br>5'-GAAGGAGCAGCTGCAAGACATGGGCCT-3' | (SEQ ID NO: 294)<br>(SEQ ID NO: 678)<br>(SEQ ID NO: 1062) |
| AT3-1235 | Target: | 5'-GGAGCAGCUGCAAGACAUGGGCCtt-3'<br>3'-UUCCUCGUCGACGUUCUGUACCCGGAA-5'<br>5'-AAGGAGCAGCTGCAAGACATGGGCCTT-3' | (SEQ ID NO: 295)<br>(SEQ ID NO: 679)<br>(SEQ ID NO: 1063) |
| AT3-1236 | Target: | 5'-GAGCAGCUGCAAGACAUGGGCCUtg-3'<br>3'-UCCUCGUCGACGUUCUGUACCCGGAAC-5'<br>5'-AGGAGCAGCTGCAAGACATGGGCCTTG-3' | (SEQ ID NO: 296)<br>(SEQ ID NO: 680)<br>(SEQ ID NO: 1064) |
| AT3-1237 | Target: | 5'-AGCAGCUGCAAGACAUGGGCCUUgt-3'<br>3'-CCUCGUCGACGUUCUGUACCCGGAACA-5'<br>5'-GGAGCAGCTGCAAGACATGGGCCTTGT-3' | (SEQ ID NO: 297)<br>(SEQ ID NO: 681)<br>(SEQ ID NO: 1065) |
| AT3-1238 | Target: | 5'-GCAGCUGCAAGACAUGGGCCUUGtc-3'<br>3'-CUCGUCGACGUUCUGUACCCGGAACAG-5'<br>5'-GAGCAGCTGCAAGACATGGGCCTTGTC-3' | (SEQ ID NO: 298)<br>(SEQ ID NO: 682)<br>(SEQ ID NO: 1066) |
| AT3-1239 | Target: | 5'-CAGCUGCAAGACAUGGGCCUUGUcg-3'<br>3'-UCGUCGACGUUCUGUACCCGGAACAGC-5'<br>5'-AGCAGCTGCAAGACATGGGCCTTGTCG-3' | (SEQ ID NO: 299)<br>(SEQ ID NO: 683)<br>(SEQ ID NO: 1067) |
| AT3-1240 | Target: | 5'-AGCUGCAAGACAUGGGCCUUGUCga-3'<br>3'-CGUCGACGUUCUGUACCCGGAACAGCU-5'<br>5'-GCAGCTGCAAGACATGGGCCTTGTCGA-3' | (SEQ ID NO: 300)<br>(SEQ ID NO: 684)<br>(SEQ ID NO: 1068) |
| AT3-1258 | Target: | 5'-UUGUCGAUCUGUUCAGCCCUGAAaa-3'<br>3'-GGAACAGCUAGACAAGUCGGGACUUUU-5'<br>5'-CCTTGTCGATCTGTTCAGCCCTGAAAA-3' | (SEQ ID NO: 301)<br>(SEQ ID NO: 685)<br>(SEQ ID NO: 1069) |
| AT3-1260 | Target: | 5'-GUCGAUCUGUUCAGCCCUGAAAAgt-3'<br>3'-AACAGCUAGACAAGUCGGGACUUUUCA-5'<br>5'-TTGTCGATCTGTTCAGCCCTGAAAAGT-3' | (SEQ ID NO: 302)<br>(SEQ ID NO: 686)<br>(SEQ ID NO: 1070) |
| AT3-1261 | Target: | 5'-UCGAUCUGUUCAGCCCUGAAAAGtc-3'<br>3'-ACAGCUAGACAAGUCGGGACUUUUCAG-5'<br>5'-TGTCGATCTGTTCAGCCCTGAAAAGTC-3' | (SEQ ID NO: 303)<br>(SEQ ID NO: 687)<br>(SEQ ID NO: 1071) |
| AT3-1263 | Target: | 5'-GAUCUGUUCAGCCCUGAAAAGUCca-3'<br>3'-AGCUAGACAAGUCGGGACUUUUCAGGU-5'<br>5'-TCGATCTGTTCAGCCCTGAAAAGTCCA-3' | (SEQ ID NO: 304)<br>(SEQ ID NO: 688)<br>(SEQ ID NO: 1072) |
| AT3-1266 | Target: | 5'-CUGUUCAGCCCUGAAAAGUCCAAac-3'<br>3'-UAGACAAGUCGGGACUUUUCAGGUUUG-5'<br>5'-ATCTGTTCAGCCCTGAAAAGTCCAAAC-3' | (SEQ ID NO: 305)<br>(SEQ ID NO: 689)<br>(SEQ ID NO: 1073) |
| AT3-1268 | Target: | 5'-GUUCAGCCCUGAAAAGUCCAAACtc-3'<br>3'-GACAAGUCGGGACUUUUCAGGUUUGAG-5'<br>5'-CTGTTCAGCCCTGAAAAGTCCAAACTC-3' | (SEQ ID NO: 306)<br>(SEQ ID NO: 690)<br>(SEQ ID NO: 1074) |
| AT3-1280 | Target: | 5'-AAAGUCCAAACUCCCAGGUAUUGtt-3'<br>3'-CUUUUCAGGUUUGAGGGUCCAUAACAA-5'<br>5'-GAAAAGTCCAAACTCCCAGGTATTGTT-3' | (SEQ ID NO: 307)<br>(SEQ ID NO: 691)<br>(SEQ ID NO: 1075) |

TABLE 2-continued

Selected Human Anti-AT3 DsiRNA Agents (Asymmetrics)

```
                      5'-AAGUCCAAACUCCCAGGUAUUGUUGtg-3'   (SEQ ID NO: 308)
                      3'-UUUUCAGGUUUGAGGGUCCAUAACAAC-5'   (SEQ ID NO: 692)
AT3-1281 Target:      5'-AAAAGTCCAAACTCCCAGGTATTGTTG-3'   (SEQ ID NO: 1076)

5'-GUCCAAACUCCCAGGUAUUGUUGca-3'     (SEQ ID NO: 309)
                      3'-UUCAGGUUUGAGGGUCCAUAACAACGU-5'   (SEQ ID NO: 693)
AT3-1283 Target:      5'-AAGTCCAAACTCCCAGGTATTGTTGCA-3'   (SEQ ID NO: 1077)

5'-CCAAACUCCCAGGUAUUGUUGCAga-3'     (SEQ ID NO: 310)
                      3'-CAGGUUUGAGGGUCCAUAACAACGUCU-5'   (SEQ ID NO: 694)
AT3-1285 Target:      5'-GTCCAAACTCCCAGGTATTGTTGCAGA-3'   (SEQ ID NO: 1078)

5'-CAAACUCCCAGGUAUUGUUGCAGaa-3'     (SEQ ID NO: 311)
                      3'-AGGUUUGAGGGUCCAUAACAACGUCUU-5'   (SEQ ID NO: 695)
AT3-1286 Target:      5'-TCCAAACTCCCAGGTATTGTTGCAGAA-3'   (SEQ ID NO: 1079)

5'-AAACUCCCAGGUAUUGUUGCAGAag-3'     (SEQ ID NO: 312)
                      3'-GGUUUGAGGGUCCAUAACAACGUCUUC-5'   (SEQ ID NO: 696)
AT3-1287 Target:      5'-CCAAACTCCCAGGTATTGTTGCAGAAG-3'   (SEQ ID NO: 1080)

5'-AACUCCCAGGUAUUGUUGCAGAAgg-3'     (SEQ ID NO: 313)
                      3'-GUUUGAGGGUCCAUAACAACGUCUUCC-5'   (SEQ ID NO: 697)
AT3-1288 Target:      5'-CAAACTCCCAGGTATTGTTGCAGAAGG-3'   (SEQ ID NO: 1081)

5'-CAUAAGGCAUUUCUUGAGGUAAAtg-3'     (SEQ ID NO: 314)
                      3'-AGGUAUUCCGUAAAGAACUCCAUUUAC-5'   (SEQ ID NO: 698)
AT3-1344 Target:      5'-TCCATAAGGCATTTCTTGAGGTAAATG-3'   (SEQ ID NO: 1082)

5'-AUAAGGCAUUUCUUGAGGUAAAUga-3'     (SEQ ID NO: 315)
                      3'-GGUAUUCCGUAAAGAACUCCAUUUACU-5'   (SEQ ID NO: 699)
AT3-1345 Target:      5'-CCATAAGGCATTTCTTGAGGTAAATGA-3'   (SEQ ID NO: 1083)

5'-UAAGGCAUUUCUUGAGGUAAAUGaa-3'     (SEQ ID NO: 316)
                      3'-GUAUUCCGUAAAGAACUCCAUUUACUU-5'   (SEQ ID NO: 700)
AT3-1346 Target:      5'-CATAAGGCATTTCTTGAGGTAAATGAA-3'   (SEQ ID NO: 1084)

5'-AAGGCAUUUCUUGAGGUAAAUGAag-3'     (SEQ ID NO: 317)
                      3'-UAUUCCGUAAAGAACUCCAUUUACUUC-5'   (SEQ ID NO: 701)
AT3-1347 Target:      5'-ATAAGGCATTTCTTGAGGTAAATGAAG-3'   (SEQ ID NO: 1085)

5'-AGGCAUUUCUUGAGGUAAAUGAAga-3'     (SEQ ID NO: 318)
                      3'-AUUCCGUAAAGAACUCCAUUUACUUCU-5'   (SEQ ID NO: 702)
AT3-1348 Target:      5'-TAAGGCATTTCTTGAGGTAAATGAAGA-3'   (SEQ ID NO: 1086)

5'-GGCAUUUCUUGAGGUAAAUGAAGaa-3'     (SEQ ID NO: 319)
                      3'-UUCCGUAAAGAACUCCAUUUACUUCUU-5'   (SEQ ID NO: 703)
AT3-1349 Target:      5'-AAGGCATTTCTTGAGGTAAATGAAGAA-3'   (SEQ ID NO: 1087)

5'-GCAUUUCUUGAGGUAAAUGAAGAag-3'     (SEQ ID NO: 320)
                      3'-UCCGUAAAGAACUCCAUUUACUUCUUC-5'   (SEQ ID NO: 704)
AT3-1350 Target:      5'-AGGCATTTCTTGAGGTAAATGAAGAAG-3'   (SEQ ID NO: 1088)

5'-CAUUUCUUGAGGUAAAUGAAGAAgg-3'     (SEQ ID NO: 321)
                      3'-CCGUAAAGAACUCCAUUUACUUCUUCC-5'   (SEQ ID NO: 705)
AT3-1351 Target:      5'-GGCATTTCTTGAGGTAAATGAAGAAGG-3'   (SEQ ID NO: 1089)

5'-UGAGGUAAAUGAAGAAGGCAGUGaa-3'     (SEQ ID NO: 322)
                      3'-GAACUCCAUUUACUUCUUCCGUCACUU-5'   (SEQ ID NO: 706)
AT3-1358 Target:      5'-CTTGAGGTAAATGAAGAAGGCAGTGAA-3'   (SEQ ID NO: 1090)

5'-GAGGUAAAUGAAGAAGGCAGUGAag-3'     (SEQ ID NO: 323)
                      3'-AACUCCAUUUACUUCUUCCGUCACUUC-5'   (SEQ ID NO: 707)
AT3-1359 Target:      5'-TTGAGGTAAATGAAGAAGGCAGTGAAG-3'   (SEQ ID NO: 1091)

5'-AGGUAAAUGAAGAAGGCAGUGAAgc-3'     (SEQ ID NO: 324)
                      3'-ACUCCAUUUACUUCUUCCGUCACUUCG-5'   (SEQ ID NO: 708)
AT3-1360 Target:      5'-TGAGGTAAATGAAGAAGGCAGTGAAGC-3'   (SEQ ID NO: 1092)

5'-GGUAAAUGAAGAAGGCAGUGAAGca-3'     (SEQ ID NO: 325)
                      3'-CUCCAUUUACUUCUUCCGUCACUUCGU-5'   (SEQ ID NO: 709)
AT3-1361 Target:      5'-GAGGTAAATGAAGAAGGCAGTGAAGCA-3'   (SEQ ID NO: 1093)

5'-GUAAAUGAAGAAGGCAGUGAAGCag-3'     (SEQ ID NO: 326)
                      3'-UCCAUUUACUUCUUCCGUCACUUCGUC-5'   (SEQ ID NO: 710)
AT3-1362 Target:      5'-AGGTAAATGAAGAAGGCAGTGAAGCAG-3'   (SEQ ID NO: 1094)
```

TABLE 2-continued

Selected Human Anti-AT3 DsiRNA Agents (Asymmetrics)

|  |  |  |
|---|---|---|
| AT3-1363 Target: | 5'-UA<u>AA</u>UGAAGAAGG<u>C</u>AGUGAAGCAgc-3'<br>3'-<u>CC</u>AUUUACUUCUUC<u>CG</u>UCACUUC<u>G</u>UCG-5'<br>5'-GGTAAATGAAGAAGGCAGTGAAGCAGC-3' | (SEQ ID NO: 327)<br>(SEQ ID NO: 711)<br>(SEQ ID NO: 1095) |
| AT3-1364 Target: | 5'-A<u>AA</u>UGAAGAAGG<u>C</u>AGUGAAGCAGct-3'<br>3'-<u>C</u>AUUUACUUCUUC<u>G</u>U<u>C</u>ACUUC<u>G</u>UCGA-5'<br>5'-GTAAATGAAGAAGGCAGTGAAGCAGCT-3' | (SEQ ID NO: 328)<br>(SEQ ID NO: 712)<br>(SEQ ID NO: 1096) |
| AT3-1369 Target: | 5'-AAGAAGGCAGUGA<u>AG</u>CAGCUGCAag-3'<br>3'-<u>A</u>CUUCUUCCGUCAC<u>UU</u>CGUCGACG<u>UU</u>C-5'<br>5'-TGAAGAAGGCAGTGAAGCAGCTGCAAG-3' | (SEQ ID NO: 329)<br>(SEQ ID NO: 713)<br>(SEQ ID NO: 1097) |
| AT3-1372 Target: | 5'-AAGGCAGUGAAGC<u>AG</u>CUGCAAGUac-3'<br>3'-<u>U</u>CUUCCGUCACUUC<u>GU</u>CGACGUUC<u>A</u>UG-5'<br>5'-AGAAGGCAGTGAAGCAGCTGCAAGTAC-3' | (SEQ ID NO: 330)<br>(SEQ ID NO: 714)<br>(SEQ ID NO: 1098) |
| AT3-1373 Target: | 5'-AGGCAGUGAAGCAG<u>C</u>UGCAAGUAcc-3'<br>3'-<u>C</u>UUCCGUCACUUC<u>G</u>U<u>C</u>GACGUUC<u>A</u>UGG-5'<br>5'-GAAGGCAGTGAAGCAGCTGCAAGTACC-3' | (SEQ ID NO: 331)<br>(SEQ ID NO: 715)<br>(SEQ ID NO: 1099) |
| AT3-1381 Target: | 5'-AAGCAGCUGCAAGU<u>AC</u>CGCUGUUgt-3'<br>3'-<u>A</u>CUUCGUCGACGUUC<u>A</u>UGGCGAC<u>AA</u>CA-5'<br>5'-TGAAGCAGCTGCAAGTACCGCTGTTGT-3' | (SEQ ID NO: 332)<br>(SEQ ID NO: 716)<br>(SEQ ID NO: 1100) |
| AT3-1452 Target: | 5'-A<u>AC</u>AGGCCUUUCC<u>UGG</u>UUUUUAUaa-3'<br>3'-<u>GG</u>UUGUCCGGAAAGG<u>A</u>CCAAAAAU<u>AUU</u>-5'<br>5'-CCAACAGGCCTTTCCTGGTTTTTATAA-3' | (SEQ ID NO: 333)<br>(SEQ ID NO: 717)<br>(SEQ ID NO: 1101) |
| AT3-1453 Target: | 5'-<u>A</u>CAGGCCUUUCCUG<u>G</u>UUUUUAUAag-3'<br>3'-<u>GU</u>UGUCCGGAAAGG<u>A</u>CCAAAAAU<u>AUUC</u>-5'<br>5'-CAACAGGCCTTTCCTGGTTTTTATAAG-3' | (SEQ ID NO: 334)<br>(SEQ ID NO: 718)<br>(SEQ ID NO: 1102) |
| AT3-1454 Target: | 5'-<u>C</u>AGGCCUUUCCUGG<u>U</u>UUUUAUAAga-3'<br>3'-<u>UU</u>GUCCGGAAAGGACC<u>A</u>AAAAUAU<u>UCU</u>-5'<br>5'-AACAGGCCTTTCCTGGTTTTTATAAGA-3' | (SEQ ID NO: 335)<br>(SEQ ID NO: 719)<br>(SEQ ID NO: 1103) |
| AT3-1455 Target: | 5'-A<u>GG</u>CCUUUCCUGG<u>U</u>UUUUAUAAGag-3'<br>3'-<u>U</u>GUCCGGAAAGG<u>A</u>CC<u>A</u>AAAAUAUU<u>CUC</u>-5'<br>5'-ACAGGCCTTTCCTGGTTTTTATAAGAG-3' | (SEQ ID NO: 336)<br>(SEQ ID NO: 720)<br>(SEQ ID NO: 1104) |
| AT3-1456 Target: | 5'-GG<u>CC</u>UUUCCUGG<u>UU</u>U<u>U</u>UAUAAGAga-3'<br>3'-<u>G</u>UCCGGAAAGGACC<u>A</u>AAAAUAUU<u>CUCU</u>-5'<br>5'-CAGGCCTTTCCTGGTTTTTATAAGAGA-3' | (SEQ ID NO: 337)<br>(SEQ ID NO: 721)<br>(SEQ ID NO: 1105) |
| AT3-1457 Target: | 5'-G<u>CC</u>UUUCCUGG<u>UUUU</u>UAUAAGAGaa-3'<br>3'-<u>U</u>CCGGAAAGGACC<u>AAAAA</u>UAUUCUCUU-5'<br>5'-AGGCCTTTCCTGGTTTTTATAAGAGAA-3' | (SEQ ID NO: 338)<br>(SEQ ID NO: 722)<br>(SEQ ID NO: 1106) |
| AT3-1459 Target: | 5'-<u>C</u>UUUCCUGG<u>UUUUU</u>AUAAGAGAAgt-3'<br>3'-<u>C</u>GGAAAGGACCAAA<u>AA</u>UAUUCUCU<u>UUCA</u>-5'<br>5'-GCCTTTCCTGGTTTTTATAAGAGAAGT-3' | (SEQ ID NO: 339)<br>(SEQ ID NO: 723)<br>(SEQ ID NO: 1107) |
| AT3-1460 Target: | 5'-U<u>UU</u>CCUGG<u>UUUUU</u>A<u>U</u>AAGAGAAGtt-3'<br>3'-<u>GG</u>AAAGGACCAAAAAUAUUCUCUU<u>CAA</u>-5'<br>5'-CCTTTCCTGGTTTTTATAAGAGAAGTT-3' | (SEQ ID NO: 340)<br>(SEQ ID NO: 724)<br>(SEQ ID NO: 1108) |
| AT3-1461 Target: | 5'-UU<u>CC</u>UGGUUUUU<u>A</u>U<u>A</u>AGAGAAGUtc-3'<br>3'-<u>G</u>AAAGGACCAAAAAUAUUCUCUU<u>CAAG</u>-5'<br>5'-CTTTCCTGGTTTTTATAAGAGAAGTTC-3' | (SEQ ID NO: 341)<br>(SEQ ID NO: 725)<br>(SEQ ID NO: 1109) |
| AT3-1462 Target: | 5'-U<u>CC</u>UGGUUUUUAU<u>A</u>AGAGAAGUUcc-3'<br>3'-<u>AAA</u>GGACCAAAAAU<u>A</u>UUCUCUUC<u>AAGG</u>-5'<br>5'-TTTCCTGGTTTTTATAAGAGAAGTTCC-3' | (SEQ ID NO: 342)<br>(SEQ ID NO: 726)<br>(SEQ ID NO: 1110) |
| AT3-1463 Target: | 5'-C<u>CU</u>GGUUUUUAU<u>A</u>AGAGAAGUUCct-3'<br>3'-<u>AA</u>GGACCAAAAAUAUUCUCUUC<u>AAGGA</u>-5'<br>5'-TTCCTGGTTTTTATAAGAGAAGTTCCT-3' | (SEQ ID NO: 343)<br>(SEQ ID NO: 727)<br>(SEQ ID NO: 1111) |
| AT3-1464 Target: | 5'-C<u>U</u>GGUUUUUAUA<u>AG</u>AGAAGUUCCtc-3'<br>3'-<u>A</u>GGACCAAAAAUAU<u>U</u>CUCUUC<u>AAGGAG</u>-5'<br>5'-TCCTGGTTTTTATAAGAGAAGTTCCTC-3' | (SEQ ID NO: 344)<br>(SEQ ID NO: 728)<br>(SEQ ID NO: 1112) |
| AT3-1465 Target: | 5'-U<u>GG</u>UUUUUAUAAG<u>A</u>GAAGUUCCUct-3'<br>3'-<u>GG</u>ACCAAAAAUAUUC<u>U</u>CUUCAAG<u>GAGA</u>-5'<br>5'-CCTGGTTTTTATAAGAGAAGTTCCTCT-3' | (SEQ ID NO: 345)<br>(SEQ ID NO: 729)<br>(SEQ ID NO: 1113) |

TABLE 2-continued

Selected Human Anti-AT3 DsiRNA Agents (Asymmetrics)

```
                   5'-GGUUUUUAUAAGAGAAGUUCCUCUCtg-3'     (SEQ ID NO: 346)
                   3'-GACCAAAAAUAUUCUCUUCAAGGAGAC-5'     (SEQ ID NO: 730)
AT3-1466  Target:  5'-CTGGTTTTTATAAGAGAAGTTCCTCTG-3'     (SEQ ID NO: 1114)

5'-GUUUUUAUAAGAGAAGUUCCUCUGa-3'      (SEQ ID NO: 347)
                   3'-ACCAAAAAUAUUCUCUUCAAGGAGACU-5'     (SEQ ID NO: 731)
AT3-1467  Target:  5'-TGGTTTTTATAAGAGAAGTTCCTCTGA-3'     (SEQ ID NO: 1115)

5'-UUUUUAUAAGAGAAGUUCCUCUGaa-3'      (SEQ ID NO: 348)
                   3'-CCAAAAAUAUUCUCUUCAAGGAGACUU-5'     (SEQ ID NO: 732)
AT3-1468  Target:  5'-GGTTTTTATAAGAGAAGTTCCTCTGAA-3'     (SEQ ID NO: 1116)

5'-UUUUAUAAGAGAAGUUCCUCUGAac-3'      (SEQ ID NO: 349)
                   3'-CAAAAAUAUUCUCUUCAAGGAGACUUG-5'     (SEQ ID NO: 733)
AT3-1469  Target:  5'-GTTTTATAAGAGAAGTTCCTCTGAAC-3'     (SEQ ID NO: 1117)

5'-UUUAUAAGAGAAGUUCCUCUGAAca-3'      (SEQ ID NO: 350)
                   3'-AAAAAUAUUCUCUUCAAGGAGACUUGU-5'     (SEQ ID NO: 734)
AT3-1470  Target:  5'-TTTTTATAAGAGAAGTTCCTCTGAACA-3'     (SEQ ID NO: 1118)

5'-UUAUAAGAGAAGUUCCUCUGAACac-3'      (SEQ ID NO: 351)
                   3'-AAAAUAUUCUCUUCAAGGAGACUUGUG-5'     (SEQ ID NO: 735)
AT3-1471  Target:  5'-TTTTATAAGAGAAGTTCCTCTGAACAC-3'     (SEQ ID NO: 1119)

5'-UAUAAGAGAAGUUCCUCUGAACAct-3'      (SEQ ID NO: 352)
                   3'-AAAUAUUCUCUUCAAGGAGACUUGUGA-5'     (SEQ ID NO: 736)
AT3-1472  Target:  5'-TTTATAAGAGAAGTTCCTCTGAACACT-3'     (SEQ ID NO: 1120)

5'-AUAAGAGAAGUUCCUCUGAACACta-3'      (SEQ ID NO: 353)
                   3'-AAUAUUCUCUUCAAGGAGACUUGUGAU-5'     (SEQ ID NO: 737)
AT3-1473  Target:  5'-TTATAAGAGAAGTTCCTCTGAACACTA-3'     (SEQ ID NO: 1121)

5'-UAAGAGAAGUUCCUCUGAACACUat-3'      (SEQ ID NO: 354)
                   3'-AUAUUCUCUUCAAGGAGACUUGUGAUA-5'     (SEQ ID NO: 738)
AT3-1474  Target:  5'-TATAAGAGAAGTTCCTCTGAACACTAT-3'     (SEQ ID NO: 1122)

5'-AAGAGAAGUUCCUCUGAACACUAtt-3'      (SEQ ID NO: 355)
                   3'-UAUUCUCUUCAAGGAGACUUGUGAUAA-5'     (SEQ ID NO: 739)
AT3-1475  Target:  5'-ATAAGAGAAGTTCCTCTGAACACTATT-3'     (SEQ ID NO: 1123)

5'-AGAGAAGUUCCUCUGAACACUAUta-3'      (SEQ ID NO: 356)
                   3'-AUUCUCUUCAAGGAGACUUGUGAUAAU-5'     (SEQ ID NO: 740)
AT3-1476  Target:  5'-TAAGAGAAGTTCCTCTGAACACTATTA-3'     (SEQ ID NO: 1124)

5'-GAGAAGUUCCUCUGAACACUAUUat-3'      (SEQ ID NO: 357)
                   3'-UUCUCUUCAAGGAGACUUGUGAUAAUA-5'     (SEQ ID NO: 741)
AT3-1477  Target:  5'-AAGAGAAGTTCCTCTGAACACTATTAT-3'     (SEQ ID NO: 1125)

5'-AGAAGUUCCUCUGAACACUAUUAtc-3'      (SEQ ID NO: 358)
                   3'-UCUCUUCAAGGAGACUUGUGAUAAUAG-5'     (SEQ ID NO: 742)
AT3-1478  Target:  5'-AGAGAAGTTCCTCTGAACACTATTATC-3'     (SEQ ID NO: 1126)

5'-GAAGUUCCUCUGAACACUAUUAUct-3'      (SEQ ID NO: 359)
                   3'-CUCUUCAAGGAGACUUGUGAUAAUAGA-5'     (SEQ ID NO: 743)
AT3-1479  Target:  5'-GAGAAGTTCCTCTGAACACTATTATCT-3'     (SEQ ID NO: 1127)

5'-AAGUUCCUCUGAACACUAUUAUCtt-3'      (SEQ ID NO: 360)
                   3'-UCUUCAAGGAGACUUGUGAUAAUAGAA-5'     (SEQ ID NO: 744)
AT3-1480  Target:  5'-AGAAGTTCCTCTGAACACTATTATCTT-3'     (SEQ ID NO: 1128)

5'-AGUUCCUCUGAACACUAUUAUCUtc-3'      (SEQ ID NO: 361)
                   3'-CUUCAAGGAGACUUGUGAUAAUAGAAG-5'     (SEQ ID NO: 745)
AT3-1481  Target:  5'-GAAGTTCCTCTGAACACTATTATCTTC-3'     (SEQ ID NO: 1129)

5'-GUUCCUCUGAACACUAUUAUCUUca-3'      (SEQ ID NO: 362)
                   3'-UUCAAGGAGACUUGUGAUAAUAGAAGU-5'     (SEQ ID NO: 746)
AT3-1482  Target:  5'-AAGTTCCTCTGAACACTATTATCTTCA-3'     (SEQ ID NO: 1130)

5'-UUCCUCUGAACACUAUUAUCUUCat-3'      (SEQ ID NO: 363)
                   3'-UCAAGGAGACUUGUGAUAAUAGAAGUA-5'     (SEQ ID NO: 747)
AT3-1483  Target:  5'-AGTTCCTCTGAACACTATTATCTTCAT-3'     (SEQ ID NO: 1131)

5'-UCCUCUGAACACUAUUAUCUUCAtg-3'      (SEQ ID NO: 364)
                   3'-CAAGGAGACUUGUGAUAAUAGAAGUAC-5'     (SEQ ID NO: 748)
AT3-1484  Target:  5'-GTTCCTCTGAACACTATTATCTTCATG-3'     (SEQ ID NO: 1132)
```

TABLE 2-continued

Selected Human Anti-AT3 DsiRNA Agents (Asymmetrics)

```
                  5'-CCUCUGAACACUAUUAUCUUCAUgg-3'      (SEQ ID NO: 365)
                  3'-AAGGAGACUUGUGAUAAUAGAAGUACC-5'    (SEQ ID NO: 749)
AT3-1485 Target:  5'-TTCCTCTGAACACTATTATCTTCATGG-3'    (SEQ ID NO: 1133)

5'-CUCUGAACACUAUUAUCUUCAUGgg-3'      (SEQ ID NO: 366)
                  3'-AGGAGACUUGUGAUAAUAGAAGUACCC-5'    (SEQ ID NO: 750)
AT3-1486 Target:  5'-TCCTCTGAACACTATTATCTTCATGGG-3'    (SEQ ID NO: 1134)

5'-CUGAACACUAUUAUCUUCAUGGGca-3'      (SEQ ID NO: 367)
                  3'-GAGACUUGUGAUAAUAGAAGUACCCGU-5'    (SEQ ID NO: 751)
AT3-1488 Target:  5'-CTCTGAACACTATTATCTTCATGGGCA-3'    (SEQ ID NO: 1135)

5'-CACUAUUAUCUUCAUGGGCAGAGta-3'      (SEQ ID NO: 368)
                  3'-UUGUGAUAAUAGAAGUACCCGUCUCAU-5'    (SEQ ID NO: 752)
AT3-1493 Target:  5'-AACACTATTATCTTCATGGGCAGAGTA-3'    (SEQ ID NO: 1136)

5'-AGAAGUAAAAAUAAAUACAAACUac-3'      (SEQ ID NO: 369)
                  3'-UGUCUUCAUUUUUAUUUAUGUUUGAUG-5'    (SEQ ID NO: 753)
AT3-1584 Target:  5'-ACAGAAGTAAAAATAAATACAAACTAC-3'    (SEQ ID NO: 1137)

5'-GAAGUAAAAAUAAAUACAAACUAct-3'      (SEQ ID NO: 370)
                  3'-GUCUUCAUUUUUAUUUAUGUUUGAUGA-5'    (SEQ ID NO: 754)
AT3-1585 Target:  5'-CAGAAGTAAAAATAAATACAAACTACT-3'    (SEQ ID NO: 1138)

5'-GGUGAGAUAUAAGACAUAAUCAGaa-3'      (SEQ ID NO: 371)
                  3'-CACCACUCUAUAUUCUGUAUUAGUCUU-5'    (SEQ ID NO: 755)
AT3-m78 Target:   5'-GTGGTGAGATATAAGACATAATCAGAA-3'    (SEQ ID NO: 1139)

5'-AGCAGCUGAUGGAGGUUUUUAAAtt-3'      (SEQ ID NO: 372)
                  3'-GUUCGUCGACUACCUCCAAAAAUUUAA-5'    (SEQ ID NO: 756)
AT3-m634 Target:  5'-CAAGCAGCTGATGGAGGTTTTTAAATT-3'    (SEQ ID NO: 1140)

5'-AUGGAGGUUUUUAAAUUUGAUACca-3'      (SEQ ID NO: 373)
                  3'-ACUACCUCCAAAAAUUUAAACUAUGGU-5'    (SEQ ID NO: 757)
AT3-m642 Target:  5'-TGATGGAGGTTTTTAAATTTGATACCA-3'    (SEQ ID NO: 1141)

5'-GGAAGUUGCACUGAACACUAUUAta-3'      (SEQ ID NO: 374)
                  3'-UCCCUUCAACGUGACUUGUGAUAAUAU-5'    (SEQ ID NO: 758)
AT3-m1574 Target: 5'-AGGGAAGTTGCACTGAACACTATTATA-3'    (SEQ ID NO: 1142)

5'-AGUUGCACUGAACACUAUUAUAUtc-3'      (SEQ ID NO: 375)
                  3'-CUUCAACGUGACUUGUGAUAAUAUAAG-5'    (SEQ ID NO: 759)
AT3-m1577 Target: 5'-GAAGTTGCACTGAACACTATTATATTC-3'    (SEQ ID NO: 1143)

5'-UUGCACUGAACACUAUUAUAUUCat-3'      (SEQ ID NO: 376)
                  3'-UCAACGUGACUUGUGAUAAUAUAAGUA-5'    (SEQ ID NO: 760)
AT3-m1579 Target: 5'-AGTTGCACTGAACACTATTATATTCAT-3'    (SEQ ID NO: 1144)

5'-CUUUGGUGUUUGUGAAUAGAAGUaa-3'      (SEQ ID NO: 377)
                  3'-AUGAAACCACAAACACUUAUCUUCAUU-5'    (SEQ ID NO: 761)
AT3-m1664 Target: 5'-TACTTTGGTGTTTGTGAATAGAAGTAA-3'    (SEQ ID NO: 1145)

5'-GGUGUUUGUGAAUAGAAGUAAAAat-3'      (SEQ ID NO: 378)
                  3'-AACCACAAACACUUAUCUUCAUUUUUA-5'    (SEQ ID NO: 762)
AT3-m1668 Target: 5'-TTGGTGTTTGTGAATAGAAGTAAAAAT-3'    (SEQ ID NO: 1146)

5'-GUGUUUGUGAAUAGAAGUAAAAAta-3'      (SEQ ID NO: 379)
                  3'-ACCACAAACACUUAUCUUCAUUUUUAU-5'    (SEQ ID NO: 763)
AT3-m1669 Target: 5'-TGGTGTTTGTGAATAGAAGTAAAAATA-3'    (SEQ ID NO: 1147)

5'-UGUUUGUGAAUAGAAGUAAAAAUaa-3'      (SEQ ID NO: 380)
                  3'-CCACAAACACUUAUCUUCAUUUUUAUU-5'    (SEQ ID NO: 764)
AT3-m1670 Target: 5'-GGTGTTTGTGAATAGAAGTAAAAATAA-3'    (SEQ ID NO: 1148)

5'-GUUUGUGAAUAGAAGUAAAAAUAaa-3'      (SEQ ID NO: 381)
                  3'-CACAAACACUUAUCUUCAUUUUUAUUU-5'    (SEQ ID NO: 765)
AT3-m1671 Target: 5'-GTGTTTGTGAATAGAAGTAAAAATAAA-3'    (SEQ ID NO: 1149)

5'-GUGAAUAGAAGUAAAAAUAAAUAcg-3'      (SEQ ID NO: 382)
                  3'-AACACUUAUCUUCAUUUUUAUUUAUGC-5'    (SEQ ID NO: 766)
AT3-m1675 Target: 5'-TTGTGAATAGAAGTAAAAATAAATACG-3'    (SEQ ID NO: 1150)

5'-AAGAGGUAAAUAUAUUACUAUUUca-3'      (SEQ ID NO: 383)
                  3'-UGUUCUCCAUUUAUAUAAUGAUAAAGU-5'    (SEQ ID NO: 767)
AT3-m1949 Target: 5'-ACAAGAGGTAAATATATTACTATTTCA-3'    (SEQ ID NO: 1151)
```

TABLE 2-continued

Selected Human Anti-AT3 DsiRNA Agents (Asymmetrics)

|   |   |   |
|---|---|---|
|  | 5'-A<u>GA</u>AAUGCAUUUUU<u>AU</u>ACAAAAAaa-3' | (SEQ ID NO: 384) |
|  | 3'-<u>UCUC</u>UUUACGUAAA<u>AA</u>UAUGUUUUUUU-5' | (SEQ ID NO: 768) |
| AT3-m2166 Target: | 5'-AGAGAAATGCATTTTTATACAAAAAAA-3' | (SEQ ID NO: 1152) |

TABLE 3

Selected Human Anti-AT3 DsiRNAs, Unmodified Duplexes (Asymmetries)

|   |   |   |
|---|---|---|
|  | 5'-CCAUGUAUUCCAAUGUGAUAGGAAC-3' | (SEQ ID NO: 1153) |
|  | 3'-CCGGUACAUAAGGUUACACUAUCCUUG-5' | (SEQ ID NO: 385) |
| AT3-142 Target: | 5'-GGCCATGTATTCCAATGTGATAGGAAC-3' | (SEQ ID NO: 769) |
|  | 5'-CAUGUAUUCCAAUGUGAUAGGAACU-3' | (SEQ ID NO: 1154) |
|  | 3'-CGGUACAUAAGGUUACACUAUCCUUGA-5' | (SEQ ID NO: 386) |
| AT3-143 Target: | 5'-GCCATGTATTCCAATGTGATAGGAACT-3' | (SEQ ID NO: 770) |
|  | 5'-AUGUAUUCCAAUGUGAUAGGAACUG-3' | (SEQ ID NO: 1155) |
|  | 3'-GGUACAUAAGGUUACACUAUCCUUGAC-5' | (SEQ ID NO: 387) |
| AT3-144 Target: | 5'-CCATGTATTCCAATGTGATAGGAACTG-3' | (SEQ ID NO: 771) |
|  | 5'-UGUAUUCCAAUGUGAUAGGAACUGU-3' | (SEQ ID NO: 1156) |
|  | 3'-GUACAUAAGGUUACACUAUCCUUGACA-5' | (SEQ ID NO: 388) |
| AT3-145 Target: | 5'-CATGTATTCCAATGTGATAGGAACTGT-3' | (SEQ ID NO: 772) |
|  | 5'-GUAUUCCAAUGUGAUAGGAACUGUA-3' | (SEQ ID NO: 1157) |
|  | 3'-UACAUAAGGUUACACUAUCCUUGACAU-5' | (SEQ ID NO: 389) |
| AT3-146 Target: | 5'-ATGTATTCCAATGTGATAGGAACTGTA-3' | (SEQ ID NO: 773) |
|  | 5'-UAUUCCAAUGUGAUAGGAACUGUAA-3' | (SEQ ID NO: 1158) |
|  | 3'-ACAUAAGGUUACACUAUCCUUGACAUU-5' | (SEQ ID NO: 390) |
| AT3-147 Target: | 5'-TGTATTCCAATGTGATAGGAACTGTAA-3' | (SEQ ID NO: 774) |
|  | 5'-AUUCCAAUGUGAUAGGAACUGUAAC-3' | (SEQ ID NO: 1159) |
|  | 3'-CAUAAGGUUACACUAUCCUUGACAUUG-5' | (SEQ ID NO: 391) |
| AT3-148 Target: | 5'-GTATTCCAATGTGATAGGAACTGTAAC-3' | (SEQ ID NO: 775) |
|  | 5'-CUCUGGAAAAAGGAAGGUUUAUCUU-3' | (SEQ ID NO: 1160) |
|  | 3'-UGGAGACCUUUUUCCUUCCAAAUAGAA-5' | (SEQ ID NO: 392) |
| AT3-173 Target: | 5'-ACCTCTGGAAAAAGGAAGGTTTATCTT-3' | (SEQ ID NO: 776) |
|  | 5'-UCUGGAAAAAGGAAGGUUUAUCUUU-3' | (SEQ ID NO: 1161) |
|  | 3'-GGAGACCUUUUUCCUUCCAAAUAGAAA-5' | (SEQ ID NO: 393) |
| AT3-174 Target: | 5'-CCTCTGGAAAAAGGAAGGTTTATCTTT-3' | (SEQ ID NO: 777) |
|  | 5'-CUGGAAAAAGGAAGGUUUAUCUUUU-3' | (SEQ ID NO: 1162) |
|  | 3'-GAGACCUUUUUCCUUCCAAAUAGAAAA-5' | (SEQ ID NO: 394) |
| AT3-175 Target: | 5'-CTCTGGAAAAAGGAAGGTTTATCTTTT-3' | (SEQ ID NO: 778) |
|  | 5'-GGAAAAAGGAAGGUUUAUCUUUUGU-3' | (SEQ ID NO: 1163) |
|  | 3'-GACCUUUUUCCUUCCAAAUAGAAAACA-5' | (SEQ ID NO: 395) |
| AT3-177 Target: | 5'-CTGGAAAAAGGAAGGTTTATCTTTTGT-3' | (SEQ ID NO: 779) |
|  | 5'-GAAAAAGGAAGGUUUAUCUUUUGUC-3' | (SEQ ID NO: 1164) |
|  | 3'-ACCUUUUUCCUUCCAAAUAGAAAACAG-5' | (SEQ ID NO: 396) |
| AT3-178 Target: | 5'-TGGAAAAAGGAAGGTTTATCTTTTGTC-3' | (SEQ ID NO: 780) |
|  | 5'-AAAAAGGAAGGUUUAUCUUUUGUCC-3' | (SEQ ID NO: 1165) |
|  | 3'-CCUUUUUCCUUCCAAAUAGAAAACAGG-5' | (SEQ ID NO: 397) |
| AT3-179 Target: | 5'-GGAAAAAGGAAGGTTTATCTTTTGTCC-3' | (SEQ ID NO: 781) |
|  | 5'-UCCCAUGAAUCCCAUGUGCAUUUAC-3' | (SEQ ID NO: 1166) |
|  | 3'-UAAGGGUACUUAGGGUACACGUAAAUG-5' | (SEQ ID NO: 398) |
| AT3-284 Target: | 5'-ATTCCCATGAATCCCATGTGCATTTAC-3' | (SEQ ID NO: 782) |
|  | 5'-CCCAUGAAUCCCAUGUGCAUUUACC-3' | (SEQ ID NO: 1167) |
|  | 3'-AAGGGUACUUAGGGUACACGUAAAUGG-5' | (SEQ ID NO: 399) |
| AT3-285 Target: | 5'-TTCCCATGAATCCCATGTGCATTTACC-3' | (SEQ ID NO: 783) |
|  | 5'-AUGAAUCCCAUGUGCAUUUACCGCU-3' | (SEQ ID NO: 1168) |
|  | 3'-GGUACUUAGGGUACACGUAAAUGGCGA-5' | (SEQ ID NO: 400) |
| AT3-288 Target: | 5'-CCATGAATCCCATGTGCATTTACCGCT-3' | (SEQ ID NO: 784) |
|  | 5'-UGUGCAUUUACCGCUCCCCGGAGAA-3' | (SEQ ID NO: 1169) |
|  | 3'-GUACACGUAAAUGGCGAGGGGCCUCUU-5' | (SEQ ID NO: 401) |
| AT3-298 Target: | 5'-CATGTGCATTTACCGCTCCCCGGAGAA-3' | (SEQ ID NO: 785) |

TABLE 3-continued

Selected Human Anti-AT3 DsiRNAs, Unmodified Duplexes (Asymmetries)

|  |  |  |  |
|---|---|---|---|
| AT3-381 | Target: | 5'-GUCUGGGAACUGUCCAAGGCCAAUU-3'<br>3'-CACAGACCCUUGACAGGUUCCGGUUAA-5'<br>5'-GTGTCTGGGAACTGTCCAAGGCCAATT-3' | (SEQ ID NO: 1170)<br>(SEQ ID NO: 402)<br>(SEQ ID NO: 786) |
| AT3-382 | Target: | 5'-UCUGGGAACUGUCCAAGGCCAAUUC-3'<br>3'-ACAGACCCUUGACAGGUUCCGGUUAAG-5'<br>5'-TGTCTGGGAACTGTCCAAGGCCAATTC-3' | (SEQ ID NO: 1171)<br>(SEQ ID NO: 403)<br>(SEQ ID NO: 787) |
| AT3-383 | Target: | 5'-CUGGGAACUGUCCAAGGCCAAUUCC-3'<br>3'-CAGACCCUUGACAGGUUCCGGUUAAGG-5'<br>5'-GTCTGGGAACTGTCCAAGGCCAATTCC-3' | (SEQ ID NO: 1172)<br>(SEQ ID NO: 404)<br>(SEQ ID NO: 788) |
| AT3-384 | Target: | 5'-UGGGAACUGUCCAAGGCCAAUUCCC-3'<br>3'-AGACCCUUGACAGGUUCCGGUUAAGGG-5'<br>5'-TCTGGGAACTGTCCAAGGCCAATTCCC-3' | (SEQ ID NO: 1173)<br>(SEQ ID NO: 405)<br>(SEQ ID NO: 789) |
| AT3-385 | Target: | 5'-GGGAACUGUCCAAGGCCAAUUCCCG-3'<br>3'-GACCCUUGACAGGUUCCGGUUAAGGGC-5'<br>5'-CTGGGAACTGTCCAAGGCCAATTCCCG-3' | (SEQ ID NO: 1174)<br>(SEQ ID NO: 406)<br>(SEQ ID NO: 790) |
| AT3-386 | Target: | 5'-GGAACUGUCCAAGGCCAAUUCCCGC-3'<br>3'-ACCCUUGACAGGUUCCGGUUAAGGGCG-5'<br>5'-TGGGAACTGTCCAAGGCCAATTCCCGC-3' | (SEQ ID NO: 1175)<br>(SEQ ID NO: 407)<br>(SEQ ID NO: 791) |
| AT3-387 | Target: | 5'-GAACUGUCCAAGGCCAAUUCCCGCU-3'<br>3'-CCCUUGACAGGUUCCGGUUAAGGGCGA-5'<br>5'-GGGAACTGTCCAAGGCCAATTCCCGCT-3' | (SEQ ID NO: 1176)<br>(SEQ ID NO: 408)<br>(SEQ ID NO: 792) |
| AT3-388 | Target: | 5'-AACUGUCCAAGGCCAAUUCCCGCUU-3'<br>3'-CCUUGACAGGUUCCGGUUAAGGGCGAA-5'<br>5'-GGAACTGTCCAAGGCCAATTCCCGCTT-3' | (SEQ ID NO: 1177)<br>(SEQ ID NO: 409)<br>(SEQ ID NO: 793) |
| AT3-403 | Target: | 5'-AUUCCCGCUUUGCUACCACUUUCUA-3'<br>3'-GUUAAGGGCGAAACGAUGGUGAAAGAU-5'<br>5'-CAATTCCCGCTTTGCTACCACTTTCTA-3' | (SEQ ID NO: 1178)<br>(SEQ ID NO: 410)<br>(SEQ ID NO: 794) |
| AT3-406 | Target: | 5'-CCCGCUUUGCUACCACUUUCUAUCA-3'<br>3'-AAGGGCGAAACGAUGGUGAAAGAUAGU-5'<br>5'-TTCCCGCTTTGCTACCACTTTCTATCA-3' | (SEQ ID NO: 1179)<br>(SEQ ID NO: 411)<br>(SEQ ID NO: 795) |
| AT3-407 | Target: | 5'-CCGCUUUGCUACCACUUUCUAUCAG-3'<br>3'-AGGGCGAAACGAUGGUGAAAGAUAGUC-5'<br>5'-TCCCGCTTTGCTACCACTTTCTATCAG-3' | (SEQ ID NO: 1180)<br>(SEQ ID NO: 412)<br>(SEQ ID NO: 796) |
| AT3-408 | Target: | 5'-CGCUUUGCUACCACUUUCUAUCAGC-3'<br>3'-GGGCGAAACGAUGGUGAAAGAUAGUCG-5'<br>5'-CCCGCTTTGCTACCACTTTCTATCAGC-3' | (SEQ ID NO: 1181)<br>(SEQ ID NO: 413)<br>(SEQ ID NO: 797) |
| AT3-409 | Target: | 5'-GCUUUGCUACCACUUUCUAUCAGCA-3'<br>3'-GGCGAAACGAUGGUGAAAGAUAGUCGU-5'<br>5'-CCGCTTTGCTACCACTTTCTATCAGCA-3' | (SEQ ID NO: 1182)<br>(SEQ ID NO: 414)<br>(SEQ ID NO: 798) |
| AT3-410 | Target: | 5'-CUUUGCUACCACUUUCUAUCAGCAC-3'<br>3'-GCGAAACGAUGGUGAAAGAUAGUCGUG-5'<br>5'-CGCTTTGCTACCACTTTCTATCAGCAC-3' | (SEQ ID NO: 1183)<br>(SEQ ID NO: 415)<br>(SEQ ID NO: 799) |
| AT3-411 | Target: | 5'-UUUGCUACCACUUUCUAUCAGCACC-3'<br>3'-CGAAACGAUGGUGAAAGAUAGUCGUGG-5'<br>5'-GCTTTGCTACCACTTTCTATCAGCACC-3' | (SEQ ID NO: 1184)<br>(SEQ ID NO: 416)<br>(SEQ ID NO: 800) |
| AT3-412 | Target: | 5'-UUGCUACCACUUUCUAUCAGCACCU-3'<br>3'-GAAACGAUGGUGAAAGAUAGUCGUGGA-5'<br>5'-CTTTGCTACCACTTTCTATCAGCACCT-3' | (SEQ ID NO: 1185)<br>(SEQ ID NO: 417)<br>(SEQ ID NO: 801) |
| AT3-413 | Target: | 5'-UGCUACCACUUUCUAUCAGCACCUG-3'<br>3'-AAACGAUGGUGAAAGAUAGUCGUGGAC-5'<br>5'-TTTGCTACCACTTTCTATCAGCACCTG-3' | (SEQ ID NO: 1186)<br>(SEQ ID NO: 418)<br>(SEQ ID NO: 802) |
| AT3-414 | Target: | 5'-GCUACCACUUUCUAUCAGCACCUGG-3'<br>3'-AACGAUGGUGAAAGAUAGUCGUGGACC-5'<br>5'-TTGCTACCACTTTCTATCAGCACCTGG-3' | (SEQ ID NO: 1187)<br>(SEQ ID NO: 419)<br>(SEQ ID NO: 803) |
| AT3-433 | Target: | 5'-ACCUGGCAGAUUCCAAGAAUGACAA-3'<br>3'-CGUGGACCGUCUAAGGUUCUUACUGUU-5'<br>5'-GCACCTGGCAGATTCCAAGAATGACAA-3' | (SEQ ID NO: 1188)<br>(SEQ ID NO: 420)<br>(SEQ ID NO: 804) |

TABLE 3-continued

Selected Human Anti-AT3 DsiRNAs, Unmodified Duplexes (Asymmetries)

|  |  |  |
|---|---|---|
| AT3-459 Target: | 5'-GAUAACAUUUUCCUGUCACCCCUGA-3'<br>3'-UACUAUUGUAAAAGGACAGUGGGGACU-5'<br>5'-ATGATAACATTTTCCTGTCACCCCTGA-3' | (SEQ ID NO: 1189)<br>(SEQ ID NO: 421)<br>(SEQ ID NO: 805) |
| AT3-462 Target: | 5'-AACAUUUUCCUGUCACCCCUGAGUA-3'<br>3'-UAUUGUAAAAGGACAGUGGGGACUCAU-5'<br>5'-ATAACATTTTCCTGTCACCCCTGAGTA-3' | (SEQ ID NO: 1190)<br>(SEQ ID NO: 422)<br>(SEQ ID NO: 806) |
| AT3-464 Target: | 5'-CAUUUUCCUGUCACCCCUGAGUAUC-3'<br>3'-UUGUAAAAGGACAGUGGGGACUCAUAG-5'<br>5'-AACATTTTCCTGTCACCCCTGAGTATC-3' | (SEQ ID NO: 1191)<br>(SEQ ID NO: 423)<br>(SEQ ID NO: 807) |
| AT3-495 Target: | 5'-GCUUUUGCUAUGACCAAGCUGGGUG-3'<br>3'-GCCGAAAACGAUACUGGUUCGACCCAC-5'<br>5'-CGGCTTTTGCTATGACCAAGCTGGGTG-3' | (SEQ ID NO: 1192)<br>(SEQ ID NO: 424)<br>(SEQ ID NO: 808) |
| AT3-496 Target: | 5'-CUUUUGCUAUGACCAAGCUGGGUGC-3'<br>3'-CCGAAAACGAUACUGGUUCGACCCACG-5'<br>5'-GGCTTTTGCTATGACCAAGCTGGGTGC-3' | (SEQ ID NO: 1193)<br>(SEQ ID NO: 425)<br>(SEQ ID NO: 809) |
| AT3-497 Target: | 5'-UUUUGCUAUGACCAAGCUGGGUGCC-3'<br>3'-CGAAAACGAUACUGGUUCGACCCACGG-5'<br>5'-GCTTTTGCTATGACCAAGCTGGGTGCC-3' | (SEQ ID NO: 1194)<br>(SEQ ID NO: 426)<br>(SEQ ID NO: 810) |
| AT3-498 Target: | 5'-UUUGCUAUGACCAAGCUGGGUGCCU-3'<br>3'-GAAAACGAUACUGGUUCGACCCACGGA-5'<br>5'-CTTTTGCTATGACCAAGCTGGGTGCCT-3' | (SEQ ID NO: 1195)<br>(SEQ ID NO: 427)<br>(SEQ ID NO: 811) |
| AT3-499 Target: | 5'-UUGCUAUGACCAAGCUGGGUGCCUG-3'<br>3'-AAAACGAUACUGGUUCGACCCACGGAC-5'<br>5'-TTTTGCTATGACCAAGCTGGGTGCCTG-3' | (SEQ ID NO: 1196)<br>(SEQ ID NO: 428)<br>(SEQ ID NO: 812) |
| AT3-500 Target: | 5'-UGCUAUGACCAAGCUGGGUGCCUGU-3'<br>3'-AAACGAUACUGGUUCGACCCACGGACA-5'<br>5'-TTTGCTATGACCAAGCTGGGTGCCTGT-3' | (SEQ ID NO: 1197)<br>(SEQ ID NO: 429)<br>(SEQ ID NO: 813) |
| AT3-501 Target: | 5'-GCUAUGACCAAGCUGGGUGCCUGUA-3'<br>3'-AACGAUACUGGUUCGACCCACGGACAU-5'<br>5'-TTGCTATGACCAAGCTGGGTGCCTGTA-3' | (SEQ ID NO: 1198)<br>(SEQ ID NO: 430)<br>(SEQ ID NO: 814) |
| AT3-502 Target: | 5'-CUAUGACCAAGCUGGGUGCCUGUAA-3'<br>3'-ACGAUACUGGUUCGACCCACGGACAUU-5'<br>5'-TGCTATGACCAAGCTGGGTGCCTGTAA-3' | (SEQ ID NO: 1199)<br>(SEQ ID NO: 431)<br>(SEQ ID NO: 815) |
| AT3-503 Target: | 5'-UAUGACCAAGCUGGGUGCCUGUAAU-3'<br>3'-CGAUACUGGUUCGACCCACGGACAUUA-5'<br>5'-GCTATGACCAAGCTGGGTGCCTGTAAT-3' | (SEQ ID NO: 1200)<br>(SEQ ID NO: 432)<br>(SEQ ID NO: 816) |
| AT3-504 Target: | 5'-AUGACCAAGCUGGGUGCCUGUAAUG-3'<br>3'-GAUACUGGUUCGACCCACGGACAUUAC-5'<br>5'-CTATGACCAAGCTGGGTGCCTGTAATG-3' | (SEQ ID NO: 1201)<br>(SEQ ID NO: 433)<br>(SEQ ID NO: 817) |
| AT3-505 Target: | 5'-UGACCAAGCUGGGUGCCUGUAAUGA-3'<br>3'-AUACUGGUUCGACCCACGGACAUUACU-5'<br>5'-TATGACCAAGCTGGGTGCCTGTAATGA-3' | (SEQ ID NO: 1202)<br>(SEQ ID NO: 434)<br>(SEQ ID NO: 818) |
| AT3-506 Target: | 5'-GACCAAGCUGGGUGCCUGUAAUGAC-3'<br>3'-UACUGGUUCGACCCACGGACAUUACUG-5'<br>5'-ATGACCAAGCTGGGTGCCTGTAATGAC-3' | (SEQ ID NO: 1203)<br>(SEQ ID NO: 435)<br>(SEQ ID NO: 819) |
| AT3-507 Target: | 5'-ACCAAGCUGGGUGCCUGUAAUGACA-3'<br>3'-ACUGGUUCGACCCACGGACAUUACUGU-5'<br>5'-TGACCAAGCTGGGTGCCTGTAATGACA-3' | (SEQ ID NO: 1204)<br>(SEQ ID NO: 436)<br>(SEQ ID NO: 820) |
| AT3-508 Target: | 5'-CCAAGCUGGGUGCCUGUAAUGACAC-3'<br>3'-CUGGUUCGACCCACGGACAUUACUGUG-5'<br>5'-GACCAAGCTGGGTGCCTGTAATGACAC-3' | (SEQ ID NO: 1205)<br>(SEQ ID NO: 437)<br>(SEQ ID NO: 821) |
| AT3-538 Target: | 5'-AGCAACUGAUGGAGGUAUUUAAGUU-3'<br>3'-GGUCGUUGACUACCUCCAUAAAUUCAA-5'<br>5'-CCAGCAACTGATGGAGGTATTTAAGTT-3' | (SEQ ID NO: 1206)<br>(SEQ ID NO: 438)<br>(SEQ ID NO: 822) |
| AT3-539 Target: | 5'-GCAACUGAUGGAGGUAUUUAAGUUU-3'<br>3'-GUCGUUGACUACCUCCAUAAAUUCAAA-5'<br>5'-CAGCAACTGATGGAGGTATTTAAGTTT-3' | (SEQ ID NO: 1207)<br>(SEQ ID NO: 439)<br>(SEQ ID NO: 823) |

TABLE 3-continued

Selected Human Anti-AT3 DsiRNAs, Unmodified Duplexes (Asymmetries)

| | | | |
|---|---|---|---|
| AT3-540 | Target: | 5'-CAACUGAUGGAGGUAUUUAAGUUUG-3'<br>3'-UCGUUGACUACCUCCAUAAAUUCAAAC-5'<br>5'-AGCAACTGATGGAGGTATTTAAGTTTG-3' | (SEQ ID NO: 1208)<br>(SEQ ID NO: 440)<br>(SEQ ID NO: 824) |
| AT3-541 | Target: | 5'-AACUGAUGGAGGUAUUUAAGUUUGA-3'<br>3'-CGUUGACUACCUCCAUAAAUUCAAACU-5'<br>5'-GCAACTGATGGAGGTATTTAAGTTTGA-3' | (SEQ ID NO: 1209)<br>(SEQ ID NO: 441)<br>(SEQ ID NO: 825) |
| AT3-542 | Target: | 5'-ACUGAUGGAGGUAUUUAAGUUUGAC-3'<br>3'-GUUGACUACCUCCAUAAAUUCAAACUG-5'<br>5'-CAACTGATGGAGGTATTTAAGTTTGAC-3' | (SEQ ID NO: 1210)<br>(SEQ ID NO: 442)<br>(SEQ ID NO: 826) |
| AT3-543 | Target: | 5'-CUGAUGGAGGUAUUUAAGUUUGACA-3'<br>3'-UUGACUACCUCCAUAAAUUCAAACUGU-5'<br>5'-AACTGATGGAGGTATTTAAGTTTGACA-3' | (SEQ ID NO: 1211)<br>(SEQ ID NO: 443)<br>(SEQ ID NO: 827) |
| AT3-544 | Target: | 5'-UGAUGGAGGUAUUUAAGUUUGACAC-3'<br>3'-UGACUACCUCCAUAAAUUCAAACUGUG-5'<br>5'-ACTGATGGAGGTATTTAAGTTTGACAC-3' | (SEQ ID NO: 1212)<br>(SEQ ID NO: 444)<br>(SEQ ID NO: 828) |
| AT3-545 | Target: | 5'-GAUGGAGGUAUUUAAGUUUGACACC-3'<br>3'-GACUACCUCCAUAAAUUCAAACUGUGG-5'<br>5'-CTGATGGAGGTATTTAAGTTTGACACC-3' | (SEQ ID NO: 1213)<br>(SEQ ID NO: 445)<br>(SEQ ID NO: 829) |
| AT3-546 | Target: | 5'-AUGGAGGUAUUUAAGUUUGACACCA-3'<br>3'-ACUACCUCCAUAAAUUCAAACUGUGGU-5'<br>5'-TGATGGAGGTATTTAAGTTTGACACCA-3' | (SEQ ID NO: 1214)<br>(SEQ ID NO: 446)<br>(SEQ ID NO: 830) |
| AT3-547 | Target: | 5'-UGGAGGUAUUUAAGUUUGACACCAU-3'<br>3'-CUACCUCCAUAAAUUCAAACUGUGGUA-5'<br>5'-GATGGAGGTATTTAAGTTTGACACCAT-3' | (SEQ ID NO: 1215)<br>(SEQ ID NO: 447)<br>(SEQ ID NO: 831) |
| AT3-548 | Target: | 5'-GGAGGUAUUUAAGUUUGACACCAUA-3'<br>3'-UACCUCCAUAAAUUCAAACUGUGGUAU-5'<br>5'-ATGGAGGTATTTAAGTTTGACACCATA-3' | (SEQ ID NO: 1216)<br>(SEQ ID NO: 448)<br>(SEQ ID NO: 832) |
| AT3-549 | Target: | 5'-GAGGUAUUUAAGUUUGACACCAUAU-3'<br>3'-ACCUCCAUAAAUUCAAACUGUGGUAUA-5'<br>5'-TGGAGGTATTTAAGTTTGACACCATAT-3' | (SEQ ID NO: 1217)<br>(SEQ ID NO: 449)<br>(SEQ ID NO: 833) |
| AT3-550 | Target: | 5'-AGGUAUUUAAGUUUGACACCAUAUC-3'<br>3'-CCUCCAUAAAUUCAAACUGUGGUAUAG-5'<br>5'-GGAGGTATTTAAGTTTGACACCATATC-3' | (SEQ ID NO: 1218)<br>(SEQ ID NO: 450)<br>(SEQ ID NO: 834) |
| AT3-551 | Target: | 5'-GGUAUUUAAGUUUGACACCAUAUCU-3'<br>3'-CUCCAUAAAUUCAAACUGUGGUAUAGA-5'<br>5'-GAGGTATTTAAGTTTGACACCATATCT-3' | (SEQ ID NO: 1219)<br>(SEQ ID NO: 451)<br>(SEQ ID NO: 835) |
| AT3-552 | Target: | 5'-GUAUUUAAGUUUGACACCAUAUCUG-3'<br>3'-UCCAUAAAUUCAAACUGUGGUAUAGAC-5'<br>5'-AGGTATTTAAGTTTGACACCATATCTG-3' | (SEQ ID NO: 1220)<br>(SEQ ID NO: 452)<br>(SEQ ID NO: 836) |
| AT3-553 | Target: | 5'-UAUUUAAGUUUGACACCAUAUCUGA-3'<br>3'-CCAUAAAUUCAAACUGUGGUAUAGACU-5'<br>5'-GGTATTTAAGTTTGACACCATATCTGA-3' | (SEQ ID NO: 1221)<br>(SEQ ID NO: 453)<br>(SEQ ID NO: 837) |
| AT3-554 | Target: | 5'-AUUUAAGUUUGACACCAUAUCUGAG-3'<br>3'-CAUAAAUUCAAACUGUGGUAUAGACUC-5'<br>5'-GTATTTAAGTTTGACACCATATCTGAG-3' | (SEQ ID NO: 1222)<br>(SEQ ID NO: 454)<br>(SEQ ID NO: 838) |
| AT3-555 | Target: | 5'-UUUAAGUUUGACACCAUAUCUGAGA-3'<br>3'-AUAAAUUCAAACUGUGGUAUAGACUCU-5'<br>5'-TATTTAAGTTTGACACCATATCTGAGA-3' | (SEQ ID NO: 1223)<br>(SEQ ID NO: 455)<br>(SEQ ID NO: 839) |
| AT3-556 | Target: | 5'-UUAAGUUUGACACCAUAUCUGAGAA-3'<br>3'-UAAAUUCAAACUGUGGUAUAGACUCUU-5'<br>5'-ATTTAAGTTTGACACCATATCTGAGAA-3' | (SEQ ID NO: 1224)<br>(SEQ ID NO: 456)<br>(SEQ ID NO: 840) |
| AT3-557 | Target: | 5'-UAAGUUUGACACCAUAUCUGAGAAA-3'<br>3'-AAAUUCAAACUGUGGUAUAGACUCUUU-5'<br>5'-TTTAAGTTTGACACCATATCTGAGAAA-3' | (SEQ ID NO: 1225)<br>(SEQ ID NO: 457)<br>(SEQ ID NO: 841) |
| AT3-558 | Target: | 5'-AAGUUUGACACCAUAUCUGAGAAAA-3'<br>3'-AAUUCAAACUGUGGUAUAGACUCUUUU-5'<br>5'-TTAAGTTTGACACCATATCTGAGAAAA-3' | (SEQ ID NO: 1226)<br>(SEQ ID NO: 458)<br>(SEQ ID NO: 842) |

TABLE 3-continued

Selected Human Anti-AT3 DsiRNAs, Unmodified Duplexes (Asymmetries)

| | | |
|---|---|---|
| AT3-559 Target: | 5'-AGUUUGACACCAUAUCUGAGAAAAC-3'<br>3'-AUUCAAACUGUGGUAUAGACUCUUUUG-5'<br>5'-TAAGTTTGACACCATATCTGAGAAAAC-3' | (SEQ ID NO: 1227)<br>(SEQ ID NO: 459)<br>(SEQ ID NO: 843) |
| AT3-560 Target: | 5'-GUUUGACACCAUAUCUGAGAAAACA-3'<br>3'-UUCAAACUGUGGUAUAGACUCUUUUGU-5'<br>5'-AAGTTTGACACCATATCTGAGAAAACA-3' | (SEQ ID NO: 1228)<br>(SEQ ID NO: 460)<br>(SEQ ID NO: 844) |
| AT3-561 Target: | 5'-UUUGACACCAUAUCUGAGAAAACAU-3'<br>3'-UCAAACUGUGGUAUAGACUCUUUUGUA-5'<br>5'-AGTTTGACACCATATCTGAGAAAACAT-3' | (SEQ ID NO: 1229)<br>(SEQ ID NO: 461)<br>(SEQ ID NO: 845) |
| AT3-562 Target: | 5'-UUGACACCAUAUCUGAGAAAACAUC-3'<br>3'-CAAACUGUGGUAUAGACUCUUUUGUAG-5'<br>5'-GTTTGACACCATATCTGAGAAAACATC-3' | (SEQ ID NO: 1230)<br>(SEQ ID NO: 462)<br>(SEQ ID NO: 846) |
| AT3-563 Target: | 5'-UGACACCAUAUCUGAGAAAACAUCU-3'<br>3'-AAACUGUGGUAUAGACUCUUUUGUAGA-5'<br>5'-TTTGACACCATATCTGAGAAAACATCT-3' | (SEQ ID NO: 1231)<br>(SEQ ID NO: 463)<br>(SEQ ID NO: 847) |
| AT3-564 Target: | 5'-GACACCAUAUCUGAGAAAACAUCUG-3'<br>3'-AACUGUGGUAUAGACUCUUUUGUAGAC-5'<br>5'-TTGACACCATATCTGAGAAAACATCTG-3' | (SEQ ID NO: 1232)<br>(SEQ ID NO: 464)<br>(SEQ ID NO: 848) |
| AT3-565 Target: | 5'-ACACCAUAUCUGAGAAAACAUCUGA-3'<br>3'-ACUGUGGUAUAGACUCUUUUGUAGACU-5'<br>5'-TGACACCATATCTGAGAAAACATCTGA-3' | (SEQ ID NO: 1233)<br>(SEQ ID NO: 465)<br>(SEQ ID NO: 849) |
| AT3-566 Target: | 5'-CACCAUAUCUGAGAAAACAUCUGAU-3'<br>3'-CUGUGGUAUAGACUCUUUUGUAGACUA-5'<br>5'-GACACCATATCTGAGAAAACATCTGAT-3' | (SEQ ID NO: 1234)<br>(SEQ ID NO: 466)<br>(SEQ ID NO: 850) |
| AT3-567 Target: | 5'-ACCAUAUCUGAGAAAACAUCUGAUC-3'<br>3'-UGUGGUAUAGACUCUUUUGUAGACUAG-5'<br>5'-ACACCATATCTGAGAAAACATCTGATC-3' | (SEQ ID NO: 1235)<br>(SEQ ID NO: 467)<br>(SEQ ID NO: 851) |
| AT3-568 Target: | 5'-CCAUAUCUGAGAAAACAUCUGAUCA-3'<br>3'-GUGGUAUAGACUCUUUUGUAGACUAGU-5'<br>5'-CACCATATCTGAGAAAACATCTGATCA-3' | (SEQ ID NO: 1236)<br>(SEQ ID NO: 468)<br>(SEQ ID NO: 852) |
| AT3-569 Target: | 5'-CAUAUCUGAGAAAACAUCUGAUCAG-3'<br>3'-UGGUAUAGACUCUUUUGUAGACUAGUC-5'<br>5'-ACCATATCTGAGAAAACATCTGATCAG-3' | (SEQ ID NO: 1237)<br>(SEQ ID NO: 469)<br>(SEQ ID NO: 853) |
| AT3-570 Target: | 5'-AUAUCUGAGAAAACAUCUGAUCAGA-3'<br>3'-GGUAUAGACUCUUUUGUAGACUAGUCU-5'<br>5'-CCATATCTGAGAAAACATCTGATCAGA-3' | (SEQ ID NO: 1238)<br>(SEQ ID NO: 470)<br>(SEQ ID NO: 854) |
| AT3-571 Target: | 5'-UAUCUGAGAAAACAUCUGAUCAGAU-3'<br>3'-GUAUAGACUCUUUUGUAGACUAGUCUA-5'<br>5'-CATATCTGAGAAAACATCTGATCAGAT-3' | (SEQ ID NO: 1239)<br>(SEQ ID NO: 471)<br>(SEQ ID NO: 855) |
| AT3-574 Target: | 5'-CUGAGAAAACAUCUGAUCAGAUCCA-3'<br>3'-UAGACUCUUUUGUAGACUAGUCUAGGU-5'<br>5'-ATCTGAGAAAACATCTGATCAGATCCA-3' | (SEQ ID NO: 1240)<br>(SEQ ID NO: 472)<br>(SEQ ID NO: 856) |
| AT3-575 Target: | 5'-UGAGAAAACAUCUGAUCAGAUCCAC-3'<br>3'-AGACUCUUUUGUAGACUAGUCUAGGUG-5'<br>5'-TCTGAGAAAACATCTGATCAGATCCAC-3' | (SEQ ID NO: 1241)<br>(SEQ ID NO: 473)<br>(SEQ ID NO: 857) |
| AT3-576 Target: | 5'-GAGAAAACAUCUGAUCAGAUCCACU-3'<br>3'-GACUCUUUUGUAGACUAGUCUAGGUGA-5'<br>5'-CTGAGAAAACATCTGATCAGATCCACT-3' | (SEQ ID NO: 1242)<br>(SEQ ID NO: 474)<br>(SEQ ID NO: 858) |
| AT3-577 Target: | 5'-AGAAAACAUCUGAUCAGAUCCACUU-3'<br>3'-ACUCUUUUGUAGACUAGUCUAGGUGAA-5'<br>5'-TGAGAAAACATCTGATCAGATCCACTT-3' | (SEQ ID NO: 1243)<br>(SEQ ID NO: 475)<br>(SEQ ID NO: 859) |
| AT3-589 Target: | 5'-AUCAGAUCCACUUCUUCUUUGCCAA-3'<br>3'-ACUAGUCUAGGUGAAGAAGAAACGGUU-5'<br>5'-TGATCAGATCCACTTCTTCTTTGCCAA-3' | (SEQ ID NO: 1244)<br>(SEQ ID NO: 476)<br>(SEQ ID NO: 860) |
| AT3-591 Target: | 5'-CAGAUCCACUUCUUCUUUGCCAAAC-3'<br>3'-UAGUCUAGGUGAAGAAGAAACGGUUUG-5'<br>5'-ATCAGATCCACTTCTTCTTTGCCAAAC-3' | (SEQ ID NO: 1245)<br>(SEQ ID NO: 477)<br>(SEQ ID NO: 861) |

TABLE 3-continued

Selected Human Anti-AT3 DsiRNAs, Unmodified Duplexes (Asymmetries)

| | | |
|---|---|---|
| AT3-592 Target: | 5'-AGAUCCACUUCUUCUUUGCCAAACU-3'<br>3'-AGUCUAGGUGAAGAAGAAACGGUUUGA-5'<br>5'-TCAGATCCACTTCTTCTTTGCCAAACT-3' | (SEQ ID NO: 1246)<br>(SEQ ID NO: 478)<br>(SEQ ID NO: 862) |
| AT3-593 Target: | 5'-GAUCCACUUCUUCUUUGCCAAACUG-3'<br>3'-GUCUAGGUGAAGAAGAAACGGUUUGAC-5'<br>5'-CAGATCCACTTCTTCTTTGCCAAACTG-3' | (SEQ ID NO: 1247)<br>(SEQ ID NO: 479)<br>(SEQ ID NO: 863) |
| AT3-594 Target: | 5'-AUCCACUUCUUCUUUGCCAAACUGA-3'<br>3'-UCUAGGUGAAGAAGAAACGGUUUGACU-5'<br>5'-AGATCCACTTCTTCTTTGCCAAACTGA-3' | (SEQ ID NO: 1248)<br>(SEQ ID NO: 480)<br>(SEQ ID NO: 864) |
| AT3-595 Target: | 5'-UCCACUUCUUCUUUGCCAAACUGAA-3'<br>3'-CUAGGUGAAGAAGAAACGGUUUGACUU-5'<br>5'-GATCCACTTCTTCTTTGCCAAACTGAA-3' | (SEQ ID NO: 1249)<br>(SEQ ID NO: 481)<br>(SEQ ID NO: 865) |
| AT3-596 Target: | 5'-CCACUUCUUCUUUGCCAAACUGAAC-3'<br>3'-UAGGUGAAGAAGAAACGGUUUGACUUG-5'<br>5'-ATCCACTTCTTCTTTGCCAAACTGAAC-3' | (SEQ ID NO: 1250)<br>(SEQ ID NO: 482)<br>(SEQ ID NO: 866) |
| AT3-597 Target: | 5'-CACUUCUUCUUUGCCAAACUGAACU-3'<br>3'-AGGUGAAGAAGAAACGGUUUGACUUGA-5'<br>5'-TCCACTTCTTCTTTGCCAAACTGAACT-3' | (SEQ ID NO: 1251)<br>(SEQ ID NO: 483)<br>(SEQ ID NO: 867) |
| AT3-598 Target: | 5'-ACUUCUUCUUUGCCAAACUGAACUG-3'<br>3'-GGUGAAGAAGAAACGGUUUGACUUGAC-5'<br>5'-CCACTTCTTCTTTGCCAAACTGAACTG-3' | (SEQ ID NO: 1252)<br>(SEQ ID NO: 484)<br>(SEQ ID NO: 868) |
| AT3-599 Target: | 5'-CUUCUUCUUUGCCAAACUGAACUGC-3'<br>3'-GUGAAGAAGAAACGGUUUGACUUGACG-5'<br>5'-CACTTCTTCTTTGCCAAACTGAACTGC-3' | (SEQ ID NO: 1253)<br>(SEQ ID NO: 485)<br>(SEQ ID NO: 869) |
| AT3-600 Target: | 5'-UUCUUCUUUGCCAAACUGAACUGCC-3'<br>3'-UGAAGAAGAAACGGUUUGACUUGACGG-5'<br>5'-ACTTCTTCTTTGCCAAACTGAACTGCC-3' | (SEQ ID NO: 1254)<br>(SEQ ID NO: 486)<br>(SEQ ID NO: 870) |
| AT3-601 Target: | 5'-UCUUCUUUGCCAAACUGAACUGCCG-3'<br>3'-GAAGAAGAAACGGUUUGACUUGACGGC-5'<br>5'-CTTCTTCTTTGCCAAACTGAACTGCCG-3' | (SEQ ID NO: 1255)<br>(SEQ ID NO: 487)<br>(SEQ ID NO: 871) |
| AT3-602 Target: | 5'-CUUCUUUGCCAAACUGAACUGCCGA-3'<br>3'-AAGAAGAAACGGUUUGACUUGACGGCU-5'<br>5'-TTCTTCTTTGCCAAACTGAACTGCCGA-3' | (SEQ ID NO: 1256)<br>(SEQ ID NO: 488)<br>(SEQ ID NO: 872) |
| AT3-603 Target: | 5'-UUCUUUGCCAAACUGAACUGCCGAC-3'<br>3'-AGAAGAAACGGUUUGACUUGACGGCUG-5'<br>5'-TCTTCTTTGCCAAACTGAACTGCCGAC-3' | (SEQ ID NO: 1257)<br>(SEQ ID NO: 489)<br>(SEQ ID NO: 873) |
| AT3-604 Target: | 5'-UCUUUGCCAAACUGAACUGCCGACU-3'<br>3'-GAAGAAACGGUUUGACUUGACGGCUGA-5'<br>5'-CTTCTTTGCCAAACTGAACTGCCGACT-3' | (SEQ ID NO: 1258)<br>(SEQ ID NO: 490)<br>(SEQ ID NO: 874) |
| AT3-605 Target: | 5'-CUUUGCCAAACUGAACUGCCGACUC-3'<br>3'-AAGAAACGGUUUGACUUGACGGCUGAG-5'<br>5'-TTCTTTGCCAAACTGAACTGCCGACTC-3' | (SEQ ID NO: 1259)<br>(SEQ ID NO: 491)<br>(SEQ ID NO: 875) |
| AT3-606 Target: | 5'-UUUGCCAAACUGAACUGCCGACUCU-3'<br>3'-AGAAACGGUUUGACUUGACGGCUGAGA-5'<br>5'-TCTTTGCCAAACTGAACTGCCGACTCT-3' | (SEQ ID NO: 1260)<br>(SEQ ID NO: 492)<br>(SEQ ID NO: 876) |
| AT3-607 Target: | 5'-UUGCCAAACUGAACUGCCGACUCUA-3'<br>3'-GAAACGGUUUGACUUGACGGCUGAGAU-5'<br>5'-CTTTGCCAAACTGAACTGCCGACTCTA-3' | (SEQ ID NO: 1261)<br>(SEQ ID NO: 493)<br>(SEQ ID NO: 877) |
| AT3-608 Target: | 5'-UGCCAAACUGAACUGCCGACUCUAU-3'<br>3'-AAACGGUUUGACUUGACGGCUGAGAUA-5'<br>5'-TTTGCCAAACTGAACTGCCGACTCTAT-3' | (SEQ ID NO: 1262)<br>(SEQ ID NO: 494)<br>(SEQ ID NO: 878) |
| AT3-609 Target: | 5'-GCCAAACUGAACUGCCGACUCUAUC-3'<br>3'-AACGGUUUGACUUGACGGCUGAGAUAG-5'<br>5'-TTGCCAAACTGAACTGCCGACTCTATC-3' | (SEQ ID NO: 1263)<br>(SEQ ID NO: 495)<br>(SEQ ID NO: 879) |
| AT3-610 Target: | 5'-CCAAACUGAACUGCCGACUCUAUCG-3'<br>3'-ACGGUUUGACUUGACGGCUGAGAUAGC-5'<br>5'-TGCCAAACTGAACTGCCGACTCTATCG-3' | (SEQ ID NO: 1264)<br>(SEQ ID NO: 496)<br>(SEQ ID NO: 880) |

TABLE 3-continued

Selected Human Anti-AT3 DsiRNAs, Unmodified Duplexes (Asymmetries)

| | | |
|---|---|---|
| AT3-611 Target: | 5'-CAAACUGAACUGCCGACUCUAUCGA-3'<br>3'-CGGUUUGACUUGACGGCUGAGAUAGCU-5'<br>5'-GCCAAACTGAACTGCCGACTCTATCGA-3' | (SEQ ID NO: 1265)<br>(SEQ ID NO: 497)<br>(SEQ ID NO: 881) |
| AT3-612 Target: | 5'-AAACUGAACUGCCGACUCUAUCGAA-3'<br>3'-GGUUUGACUUGACGGCUGAGAUAGCUU-5'<br>5'-CCAAACTGAACTGCCGACTCTATCGAA-3' | (SEQ ID NO: 1266)<br>(SEQ ID NO: 498)<br>(SEQ ID NO: 882) |
| AT3-613 Target: | 5'-AACUGAACUGCCGACUCUAUCGAAA-3'<br>3'-GUUUGACUUGACGGCUGAGAUAGCUUU-5'<br>5'-CAAACTGAACTGCCGACTCTATCGAAA-3' | (SEQ ID NO: 1267)<br>(SEQ ID NO: 499)<br>(SEQ ID NO: 883) |
| AT3-614 Target: | 5'-ACUGAACUGCCGACUCUAUCGAAAA-3'<br>3'-UUUGACUUGACGGCUGAGAUAGCUUUU-5'<br>5'-AAACTGAACTGCCGACTCTATCGAAAA-3' | (SEQ ID NO: 1268)<br>(SEQ ID NO: 500)<br>(SEQ ID NO: 884) |
| AT3-615 Target: | 5'-CUGAACUGCCGACUCUAUCGAAAAG-3'<br>3'-UUGACUUGACGGCUGAGAUAGCUUUUC-5'<br>5'-AACTGAACTGCCGACTCTATCGAAAAG-3' | (SEQ ID NO: 1269)<br>(SEQ ID NO: 501)<br>(SEQ ID NO: 885) |
| AT3-616 Target: | 5'-UGAACUGCCGACUCUAUCGAAAAGC-3'<br>3'-UGACUUGACGGCUGAGAUAGCUUUUCG-5'<br>5'-ACTGAACTGCCGACTCTATCGAAAAGC-3' | (SEQ ID NO: 1270)<br>(SEQ ID NO: 502)<br>(SEQ ID NO: 886) |
| AT3-617 Target: | 5'-GAACUGCCGACUCUAUCGAAAAGCC-3'<br>3'-GACUUGACGGCUGAGAUAGCUUUUCGG-5'<br>5'-CTGAACTGCCGACTCTATCGAAAAGCC-3' | (SEQ ID NO: 1271)<br>(SEQ ID NO: 503)<br>(SEQ ID NO: 887) |
| AT3-618 Target: | 5'-AACUGCCGACUCUAUCGAAAAGCCA-3'<br>3'-ACUUGACGGCUGAGAUAGCUUUUCGGU-5'<br>5'-TGAACTGCCGACTCTATCGAAAAGCCA-3' | (SEQ ID NO: 1272)<br>(SEQ ID NO: 504)<br>(SEQ ID NO: 888) |
| AT3-619 Target: | 5'-ACUGCCGACUCUAUCGAAAAGCCAA-3'<br>3'-CUUGACGGCUGAGAUAGCUUUUCGGUU-5'<br>5'-GAACTGCCGACTCTATCGAAAAGCCAA-3' | (SEQ ID NO: 1273)<br>(SEQ ID NO: 505)<br>(SEQ ID NO: 889) |
| AT3-620 Target: | 5'-CUGCCGACUCUAUCGAAAAGCCAAC-3'<br>3'-UUGACGGCUGAGAUAGCUUUUCGGUUG-5'<br>5'-AACTGCCGACTCTATCGAAAAGCCAAC-3' | (SEQ ID NO: 1274)<br>(SEQ ID NO: 506)<br>(SEQ ID NO: 890) |
| AT3-621 Target: | 5'-UGCCGACUCUAUCGAAAAGCCAACA-3'<br>3'-UGACGGCUGAGAUAGCUUUUCGGUUGU-5'<br>5'-ACTGCCGACTCTATCGAAAAGCCAACA-3' | (SEQ ID NO: 1275)<br>(SEQ ID NO: 507)<br>(SEQ ID NO: 891) |
| AT3-622 Target: | 5'-GCCGACUCUAUCGAAAAGCCAACAA-3'<br>3'-GACGGCUGAGAUAGCUUUUCGGUUGUU-5'<br>5'-CTGCCGACTCTATCGAAAAGCCAACAA-3' | (SEQ ID NO: 1276)<br>(SEQ ID NO: 508)<br>(SEQ ID NO: 892) |
| AT3-623 Target: | 5'-CCGACUCUAUCGAAAAGCCAACAAA-3'<br>3'-ACGGCUGAGAUAGCUUUUCGGUUGUUU-5'<br>5'-TGCCGACTCTATCGAAAAGCCAACAAA-3' | (SEQ ID NO: 1277)<br>(SEQ ID NO: 509)<br>(SEQ ID NO: 893) |
| AT3-624 Target: | 5'-CGACUCUAUCGAAAAGCCAACAAAU-3'<br>3'-CGGCUGAGAUAGCUUUUCGGUUGUUUA-5'<br>5'-GCCGACTCTATCGAAAAGCCAACAAAT-3' | (SEQ ID NO: 1278)<br>(SEQ ID NO: 510)<br>(SEQ ID NO: 894) |
| AT3-625 Target: | 5'-GACUCUAUCGAAAAGCCAACAAAUC-3'<br>3'-GGCUGAGAUAGCUUUUCGGUUGUUUAG-5'<br>5'-CCGACTCTATCGAAAAGCCAACAAATC-3' | (SEQ ID NO: 1279)<br>(SEQ ID NO: 511)<br>(SEQ ID NO: 895) |
| AT3-626 Target: | 5'-ACUCUAUCGAAAAGCCAACAAAUCC-3'<br>3'-GCUGAGAUAGCUUUUCGGUUGUUUAGG-5'<br>5'-CGACTCTATCGAAAAGCCAACAAATCC-3' | (SEQ ID NO: 1280)<br>(SEQ ID NO: 512)<br>(SEQ ID NO: 896) |
| AT3-627 Target: | 5'-CUCUAUCGAAAAGCCAACAAAUCCU-3'<br>3'-CUGAGAUAGCUUUUCGGUUGUUUAGGA-5'<br>5'-GACTCTATCGAAAAGCCAACAAATCCT-3' | (SEQ ID NO: 1281)<br>(SEQ ID NO: 513)<br>(SEQ ID NO: 897) |
| AT3-628 Target: | 5'-UCUAUCGAAAAGCCAACAAAUCCUC-3'<br>3'-UGAGAUAGCUUUUCGGUUGUUUAGGAG-5'<br>5'-ACTCTATCGAAAAGCCAACAAATCCTC-3' | (SEQ ID NO: 1282)<br>(SEQ ID NO: 514)<br>(SEQ ID NO: 898) |
| AT3-635 Target: | 5'-AAAAGCCAACAAAUCCUCCAAGUUA-3'<br>3'-GCUUUUCGGUUGUUUAGGAGGUUCAAU-5'<br>5'-CGAAAAGCCAACAAATCCTCCAAGTTA-3' | (SEQ ID NO: 1283)<br>(SEQ ID NO: 515)<br>(SEQ ID NO: 899) |

TABLE 3-continued

Selected Human Anti-AT3 DsiRNAs, Unmodified Duplexes (Asymmetries)

| | | |
|---|---|---|
| AT3-636 Target: | 5'-AAAGCCAACAAAUCCUCCAAGUUAG-3'<br>3'-CUUUUCGGUUGUUUAGGAGGUUCAAUC-5'<br>5'-GAAAAGCCAACAAATCCTCCAAGTTAG-3' | (SEQ ID NO: 1284)<br>(SEQ ID NO: 516)<br>(SEQ ID NO: 900) |
| AT3-639 Target: | 5'-GCCAACAAAUCCUCCAAGUUAGUAU-3'<br>3'-UUCGGUUGUUUAGGAGGUUCAAUCAUA-5'<br>5'-AAGCCAACAAATCCTCCAAGTTAGTAT-3' | (SEQ ID NO: 1285)<br>(SEQ ID NO: 517)<br>(SEQ ID NO: 901) |
| AT3-640 Target: | 5'-CCAACAAAUCCUCCAAGUUAGUAUC-3'<br>3'-UCGGUUGUUUAGGAGGUUCAAUCAUAG-5'<br>5'-AGCCAACAAATCCTCCAAGTTAGTATC-3' | (SEQ ID NO: 1286)<br>(SEQ ID NO: 518)<br>(SEQ ID NO: 902) |
| AT3-641 Target: | 5'-CAACAAAUCCUCCAAGUUAGUAUCA-3'<br>3'-CGGUUGUUUAGGAGGUUCAAUCAUAGU-5'<br>5'-GCCAACAAATCCTCCAAGTTAGTATCA-3' | (SEQ ID NO: 1287)<br>(SEQ ID NO: 519)<br>(SEQ ID NO: 903) |
| AT3-642 Target: | 5'-AACAAAUCCUCCAAGUUAGUAUCAG-3'<br>3'-GGUUGUUUAGGAGGUUCAAUCAUAGUC-5'<br>5'-CCAACAAATCCTCCAAGTTAGTATCAG-3' | (SEQ ID NO: 1288)<br>(SEQ ID NO: 520)<br>(SEQ ID NO: 904) |
| AT3-643 Target: | 5'-ACAAAUCCUCCAAGUUAGUAUCAGC-3'<br>3'-GUUGUUUAGGAGGUUCAAUCAUAGUCG-5'<br>5'-CAACAAATCCTCCAAGTTAGTATCAGC-3' | (SEQ ID NO: 1289)<br>(SEQ ID NO: 521)<br>(SEQ ID NO: 905) |
| AT3-644 Target: | 5'-CAAAUCCUCCAAGUUAGUAUCAGCC-3'<br>3'-UUGUUUAGGAGGUUCAAUCAUAGUCGG-5'<br>5'-AACAAATCCTCCAAGTTAGTATCAGCC-3' | (SEQ ID NO: 1290)<br>(SEQ ID NO: 522)<br>(SEQ ID NO: 906) |
| AT3-655 Target: | 5'-AGUUAGUAUCAGCCAAUCGCCUUUU-3'<br>3'-GUUCAAUCAUAGUCGGUUAGCGGAAAA-5'<br>5'-CAAGTTAGTATCAGCCAATCGCCTTTT-3' | (SEQ ID NO: 1291)<br>(SEQ ID NO: 523)<br>(SEQ ID NO: 907) |
| AT3-659 Target: | 5'-AGUAUCAGCCAAUCGCCUUUUUGGA-3'<br>3'-AAUCAUAGUCGGUUAGCGGAAAAACCU-5'<br>5'-TTAGTATCAGCCAATCGCCTTTTTGGA-3' | (SEQ ID NO: 1292)<br>(SEQ ID NO: 524)<br>(SEQ ID NO: 908) |
| AT3-664 Target: | 5'-CAGCCAAUCGCCUUUUUGGAGACAA-3'<br>3'-UAGUCGGUUAGCGGAAAAACCUCUGUU-5'<br>5'-ATCAGCCAATCGCCTTTTTGGAGACAA-3' | (SEQ ID NO: 1293)<br>(SEQ ID NO: 525)<br>(SEQ ID NO: 909) |
| AT3-665 Target: | 5'-AGCCAAUCGCCUUUUUGGAGACAAA-3'<br>3'-AGUCGGUUAGCGGAAAAACCUCUGUUU-5'<br>5'-TCAGCCAATCGCCTTTTTGGAGACAAA-3' | (SEQ ID NO: 1294)<br>(SEQ ID NO: 526)<br>(SEQ ID NO: 910) |
| AT3-666 Target: | 5'-GCCAAUCGCCUUUUUGGAGACAAAU-3'<br>3'-GUCGGUUAGCGGAAAAACCUCUGUUUA-5'<br>5'-CAGCCAATCGCCTTTTTGGAGACAAAT-3' | (SEQ ID NO: 1295)<br>(SEQ ID NO: 527)<br>(SEQ ID NO: 911) |
| AT3-670 Target: | 5'-AUCGCCUUUUUGGAGACAAAUCCCU-3'<br>3'-GUUAGCGGAAAAACCUCUGUUUAGGGA-5'<br>5'-CAATCGCCTTTTTGGAGACAAATCCCT-3' | (SEQ ID NO: 1296)<br>(SEQ ID NO: 528)<br>(SEQ ID NO: 912) |
| AT3-672 Target: | 5'-CGCCUUUUUGGAGACAAAUCCCUUA-3'<br>3'-UAGCGGAAAAACCUCUGUUUAGGGAAU-5'<br>5'-ATCGCCTTTTTGGAGACAAATCCCTTA-3' | (SEQ ID NO: 1297)<br>(SEQ ID NO: 529)<br>(SEQ ID NO: 913) |
| AT3-673 Target: | 5'-GCCUUUUUGGAGACAAAUCCCUUAC-3'<br>3'-AGCGGAAAAACCUCUGUUUAGGGAAUG-5'<br>5'-TCGCCTTTTTGGAGACAAATCCCTTAC-3' | (SEQ ID NO: 1298)<br>(SEQ ID NO: 530)<br>(SEQ ID NO: 914) |
| AT3-674 Target: | 5'-CCUUUUUGGAGACAAAUCCCUUACC-3'<br>3'-GCGGAAAAACCUCUGUUUAGGGAAUGG-5'<br>5'-CGCCTTTTTGGAGACAAATCCCTTACC-3' | (SEQ ID NO: 1299)<br>(SEQ ID NO: 531)<br>(SEQ ID NO: 915) |
| AT3-675 Target: | 5'-CUUUUUGGAGACAAAUCCCUUACCU-3'<br>3'-CGGAAAAACCUCUGUUUAGGGAAUGGA-5'<br>5'-GCCTTTTTGGAGACAAATCCCTTACCT-3' | (SEQ ID NO: 1300)<br>(SEQ ID NO: 532)<br>(SEQ ID NO: 916) |
| AT3-676 Target: | 5'-UUUUUGGAGACAAAUCCCUUACCUU-3'<br>3'-GGAAAAACCUCUGUUUAGGGAAUGGAA-5'<br>5'-CCTTTTTGGAGACAAATCCCTTACCTT-3' | (SEQ ID NO: 1301)<br>(SEQ ID NO: 533)<br>(SEQ ID NO: 917) |
| AT3-680 Target: | 5'-UGGAGACAAAUCCCUUACCUUCAAU-3'<br>3'-AAACCUCUGUUUAGGGAAUGGAAGUUA-5'<br>5'-TTTGGAGACAAATCCCTTACCTTCAAT-3' | (SEQ ID NO: 1302)<br>(SEQ ID NO: 534)<br>(SEQ ID NO: 918) |

TABLE 3-continued

Selected Human Anti-AT3 DsiRNAs, Unmodified Duplexes (Asymmetries)

| | | |
|---|---|---|
| AT3-681 Target: | 5'-GGAGACAAAUCCCUUACCUUCAAUG-3'<br>3'-AACCUCUGUUUAGGGAAUGGAAGUUAC-5'<br>5'-TTGGAGACAAATCCCTTACCTTCAATG-3' | (SEQ ID NO: 1303)<br>(SEQ ID NO: 535)<br>(SEQ ID NO: 919) |
| AT3-682 Target: | 5'-GAGACAAAUCCCUUACCUUCAAUGA-3'<br>3'-ACCUCUGUUUAGGGAAUGGAAGUUACU-5'<br>5'-TGGAGACAAATCCCTTACCTTCAATGA-3' | (SEQ ID NO: 1304)<br>(SEQ ID NO: 536)<br>(SEQ ID NO: 920) |
| AT3-683 Target: | 5'-AGACAAAUCCCUUACCUUCAAUGAG-3'<br>3'-CCUCUGUUUAGGGAAUGGAAGUUACUC-5'<br>5'-GGAGACAAATCCCTTACCTTCAATGAG-3' | (SEQ ID NO: 1305)<br>(SEQ ID NO: 537)<br>(SEQ ID NO: 921) |
| AT3-684 Target: | 5'-GACAAAUCCCUUACCUUCAAUGAGA-3'<br>3'-CUCUGUUUAGGGAAUGGAAGUUACUCU-5'<br>5'-GAGACAAATCCCTTACCTTCAATGAGA-3' | (SEQ ID NO: 1306)<br>(SEQ ID NO: 538)<br>(SEQ ID NO: 922) |
| AT3-685 Target: | 5'-ACAAAUCCCUUACCUUCAAUGAGAC-3'<br>3'-UCUGUUUAGGGAAUGGAAGUUACUCUG-5'<br>5'-AGACAAATCCCTTACCTTCAATGAGAC-3' | (SEQ ID NO: 1307)<br>(SEQ ID NO: 539)<br>(SEQ ID NO: 923) |
| AT3-687 Target: | 5'-AAAUCCCUUACCUUCAAUGAGACCU-3'<br>3'-UGUUUAGGGAAUGGAAGUUACUCUGGA-5'<br>5'-ACAAATCCCTTACCTTCAATGAGACCT-3' | (SEQ ID NO: 1308)<br>(SEQ ID NO: 540)<br>(SEQ ID NO: 924) |
| AT3-688 Target: | 5'-AAUCCCUUACCUUCAAUGAGACCUA-3'<br>3'-GUUUAGGGAAUGGAAGUUACUCUGGAU-5'<br>5'-CAAATCCCTTACCTTCAATGAGACCTA-3' | (SEQ ID NO: 1309)<br>(SEQ ID NO: 541)<br>(SEQ ID NO: 925) |
| AT3-689 Target: | 5'-AUCCCUUACCUUCAAUGAGACCUAC-3'<br>3'-UUUAGGGAAUGGAAGUUACUCUGGAUG-5'<br>5'-AAATCCCTTACCTTCAATGAGACCTAC-3' | (SEQ ID NO: 1310)<br>(SEQ ID NO: 542)<br>(SEQ ID NO: 926) |
| AT3-696 Target: | 5'-ACCUUCAAUGAGACCUACCAGGACA-3'<br>3'-AAUGGAAGUUACUCUGGAUGGUCCUGU-5'<br>5'-TTACCTTCAATGAGACCTACCAGGACA-3' | (SEQ ID NO: 1311)<br>(SEQ ID NO: 543)<br>(SEQ ID NO: 927) |
| AT3-700 Target: | 5'-UCAAUGAGACCUACCAGGACAUCAG-3'<br>3'-GAAGUUACUCUGGAUGGUCCUGUAGUC-5'<br>5'-CTTCAATGAGACCTACCAGGACATCAG-3' | (SEQ ID NO: 1312)<br>(SEQ ID NO: 544)<br>(SEQ ID NO: 928) |
| AT3-701 Target: | 5'-CAAUGAGACCUACCAGGACAUCAGU-3'<br>3'-AAGUUACUCUGGAUGGUCCUGUAGUCA-5'<br>5'-TTCAATGAGACCTACCAGGACATCAGT-3' | (SEQ ID NO: 1313)<br>(SEQ ID NO: 545)<br>(SEQ ID NO: 929) |
| AT3-702 Target: | 5'-AAUGAGACCUACCAGGACAUCAGUG-3'<br>3'-AGUUACUCUGGAUGGUCCUGUAGUCAC-5'<br>5'-TCAATGAGACCTACCAGGACATCAGTG-3' | (SEQ ID NO: 1314)<br>(SEQ ID NO: 546)<br>(SEQ ID NO: 930) |
| AT3-704 Target: | 5'-UGAGACCUACCAGGACAUCAGUGAG-3'<br>3'-UUACUCUGGAUGGUCCUGUAGUCACUC-5'<br>5'-AATGAGACCTACCAGGACATCAGTGAG-3' | (SEQ ID NO: 1315)<br>(SEQ ID NO: 547)<br>(SEQ ID NO: 931) |
| AT3-706 Target: | 5'-AGACCUACCAGGACAUCAGUGAGUU-3'<br>3'-ACUCUGGAUGGUCCUGUAGUCACUCAA-5'<br>5'-TGAGACCTACCAGGACATCAGTGAGTT-3' | (SEQ ID NO: 1316)<br>(SEQ ID NO: 548)<br>(SEQ ID NO: 932) |
| AT3-710 Target: | 5'-CUACCAGGACAUCAGUGAGUUGGUA-3'<br>3'-UGGAUGGUCCUGUAGUCACUCAACCAU-5'<br>5'-ACCTACCAGGACATCAGTGAGTTGGTA-3' | (SEQ ID NO: 1317)<br>(SEQ ID NO: 549)<br>(SEQ ID NO: 933) |
| AT3-711 Target: | 5'-UACCAGGACAUCAGUGAGUUGGUAU-3'<br>3'-GGAUGGUCCUGUAGUCACUCAACCAUA-5'<br>5'-CCTACCAGGACATCAGTGAGTTGGTAT-3' | (SEQ ID NO: 1318)<br>(SEQ ID NO: 550)<br>(SEQ ID NO: 934) |
| AT3-712 Target: | 5'-ACCAGGACAUCAGUGAGUUGGUAUA-3'<br>3'-GAUGGUCCUGUAGUCACUCAACCAUAU-5'<br>5'-CTACCAGGACATCAGTGAGTTGGTATA-3' | (SEQ ID NO: 1319)<br>(SEQ ID NO: 551)<br>(SEQ ID NO: 935) |
| AT3-713 Target: | 5'-CCAGGACAUCAGUGAGUUGGUAUAU-3'<br>3'-AUGGUCCUGUAGUCACUCAACCAUAUA-5'<br>5'-TACCAGGACATCAGTGAGTTGGTATAT-3' | (SEQ ID NO: 1320)<br>(SEQ ID NO: 552)<br>(SEQ ID NO: 936) |
| AT3-714 Target: | 5'-CAGGACAUCAGUGAGUUGGUAUAUG-3'<br>3'-UGGUCCUGUAGUCACUCAACCAUAUAC-5'<br>5'-ACCAGGACATCAGTGAGTTGGTATATG-3' | (SEQ ID NO: 1321)<br>(SEQ ID NO: 553)<br>(SEQ ID NO: 937) |

TABLE 3-continued

Selected Human Anti-AT3 DsiRNAs, Unmodified Duplexes (Asymmetries)

| | | |
|---|---|---|
| AT3-715 Target: | 5'-AGGACAUCAGUGAGUUGGUAUAUGG-3'<br>3'-GGUCCUGUAGUCACUCAACCAUAUACC-5'<br>5'-CCAGGACATCAGTGAGTTGGTATATGG-3' | (SEQ ID NO: 1322)<br>(SEQ ID NO: 554)<br>(SEQ ID NO: 938) |
| AT3-716 Target: | 5'-GGACAUCAGUGAGUUGGUAUAUGGA-3'<br>3'-GUCCUGUAGUCACUCAACCAUAUACCU-5'<br>5'-CAGGACATCAGTGAGTTGGTATATGGA-3' | (SEQ ID NO: 1323)<br>(SEQ ID NO: 555)<br>(SEQ ID NO: 939) |
| AT3-717 Target: | 5'-GACAUCAGUGAGUUGGUAUAUGGAG-3'<br>3'-UCCUGUAGUCACUCAACCAUAUACCUC-5'<br>5'-AGGACATCAGTGAGTTGGTATATGGAG-3' | (SEQ ID NO: 1324)<br>(SEQ ID NO: 556)<br>(SEQ ID NO: 940) |
| AT3-718 Target: | 5'-ACAUCAGUGAGUUGGUAUAUGGAGC-3'<br>3'-CCUGUAGUCACUCAACCAUAUACCUCG-5'<br>5'-GGACATCAGTGAGTTGGTATATGGAGC-3' | (SEQ ID NO: 1325)<br>(SEQ ID NO: 557)<br>(SEQ ID NO: 941) |
| AT3-735 Target: | 5'-UAUGGAGCCAAGCUCCAGCCCCUGG-3'<br>3'-AUAUACCUCGGUUCGAGGUCGGGGACC-5'<br>5'-TATATGGAGCCAAGCTCCAGCCCCTGG-3' | (SEQ ID NO: 1326)<br>(SEQ ID NO: 558)<br>(SEQ ID NO: 942) |
| AT3-736 Target: | 5'-AUGGAGCCAAGCUCCAGCCCCUGGA-3'<br>3'-UAUACCUCGGUUCGAGGUCGGGGACCU-5'<br>5'-ATATGGAGCCAAGCTCCAGCCCCTGGA-3' | (SEQ ID NO: 1327)<br>(SEQ ID NO: 559)<br>(SEQ ID NO: 943) |
| AT3-737 Target: | 5'-UGGAGCCAAGCUCCAGCCCCUGGAC-3'<br>3'-AUACCUCGGUUCGAGGUCGGGGACCUG-5'<br>5'-TATGGAGCCAAGCTCCAGCCCCTGGAC-3' | (SEQ ID NO: 1328)<br>(SEQ ID NO: 560)<br>(SEQ ID NO: 944) |
| AT3-738 Target: | 5'-GGAGCCAAGCUCCAGCCCCUGGACU-3'<br>3'-UACCUCGGUUCGAGGUCGGGGACCUGA-5'<br>5'-ATGGAGCCAAGCTCCAGCCCCTGGACT-3' | (SEQ ID NO: 1329)<br>(SEQ ID NO: 561)<br>(SEQ ID NO: 945) |
| AT3-739 Target: | 5'-GAGCCAAGCUCCAGCCCCUGGACUU-3'<br>3'-ACCUCGGUUCGAGGUCGGGGACCUGAA-5'<br>5'-TGGAGCCAAGCTCCAGCCCCTGGACTT-3' | (SEQ ID NO: 1330)<br>(SEQ ID NO: 562)<br>(SEQ ID NO: 946) |
| AT3-740 Target: | 5'-AGCCAAGCUCCAGCCCCUGGACUUC-3'<br>3'-CCUCGGUUCGAGGUCGGGGACCUGAAG-5'<br>5'-GGAGCCAAGCTCCAGCCCCTGGACTTC-3' | (SEQ ID NO: 1331)<br>(SEQ ID NO: 563)<br>(SEQ ID NO: 947) |
| AT3-741 Target: | 5'-GCCAAGCUCCAGCCCCUGGACUUCA-3'<br>3'-CUCGGUUCGAGGUCGGGGACCUGAAGU-5'<br>5'-GAGCCAAGCTCCAGCCCCTGGACTTCA-3' | (SEQ ID NO: 1332)<br>(SEQ ID NO: 564)<br>(SEQ ID NO: 948) |
| AT3-742 Target: | 5'-CCAAGCUCCAGCCCCUGGACUUCAA-3'<br>3'-UCGGUUCGAGGUCGGGGACCUGAAGUU-5'<br>5'-AGCCAAGCTCCAGCCCCTGGACTTCAA-3' | (SEQ ID NO: 1333)<br>(SEQ ID NO: 565)<br>(SEQ ID NO: 949) |
| AT3-743 Target: | 5'-CAAGCUCCAGCCCCUGGACUUCAAG-3'<br>3'-CGGUUCGAGGUCGGGGACCUGAAGUUC-5'<br>5'-GCCAAGCTCCAGCCCCTGGACTTCAAG-3' | (SEQ ID NO: 1334)<br>(SEQ ID NO: 566)<br>(SEQ ID NO: 950) |
| AT3-744 Target: | 5'-AAGCUCCAGCCCCUGGACUUCAAGG-3'<br>3'-GGUUCGAGGUCGGGGACCUGAAGUUCC-5'<br>5'-CCAAGCTCCAGCCCCTGGACTTCAAGG-3' | (SEQ ID NO: 1335)<br>(SEQ ID NO: 567)<br>(SEQ ID NO: 951) |
| AT3-745 Target: | 5'-AGCUCCAGCCCCUGGACUUCAAGGA-3'<br>3'-GUUCGAGGUCGGGGACCUGAAGUUCCU-5'<br>5'-CAAGCTCCAGCCCCTGGACTTCAAGGA-3' | (SEQ ID NO: 1336)<br>(SEQ ID NO: 568)<br>(SEQ ID NO: 952) |
| AT3-746 Target: | 5'-GCUCCAGCCCCUGGACUUCAAGGAA-3'<br>3'-UUCGAGGUCGGGGACCUGAAGUUCCUU-5'<br>5'-AAGCTCCAGCCCCTGGACTTCAAGGAA-3' | (SEQ ID NO: 1337)<br>(SEQ ID NO: 569)<br>(SEQ ID NO: 953) |
| AT3-747 Target: | 5'-CUCCAGCCCCUGGACUUCAAGGAAA-3'<br>3'-UCGAGGUCGGGGACCUGAAGUUCCUUU-5'<br>5'-AGCTCCAGCCCCTGGACTTCAAGGAAA-3' | (SEQ ID NO: 1338)<br>(SEQ ID NO: 570)<br>(SEQ ID NO: 954) |
| AT3-748 Target: | 5'-UCCAGCCCCUGGACUUCAAGGAAAA-3'<br>3'-CGAGGUCGGGGACCUGAAGUUCCUUUU-5'<br>5'-GCTCCAGCCCCTGGACTTCAAGGAAAA-3' | (SEQ ID NO: 1339)<br>(SEQ ID NO: 571)<br>(SEQ ID NO: 955) |
| AT3-749 Target: | 5'-CCAGCCCCUGGACUUCAAGGAAAAU-3'<br>3'-GAGGUCGGGGACCUGAAGUUCCUUUUA-5'<br>5'-CTCCAGCCCCTGGACTTCAAGGAAAAT-3' | (SEQ ID NO: 1340)<br>(SEQ ID NO: 572)<br>(SEQ ID NO: 956) |

TABLE 3-continued

Selected Human Anti-AT3 DsiRNAs, Unmodified Duplexes (Asymmetries)

| | | |
|---|---|---|
| AT3-750 Target: | 5'-CAGCCCCUGGACUUCAAGGAAAAUG-3'<br>3'-AGGUCGGGGACCUGAAGUUCCUUUUAC-5'<br>5'-TCCAGCCCCTGGACTTCAAGGAAAATG-3' | (SEQ ID NO: 1341)<br>(SEQ ID NO: 573)<br>(SEQ ID NO: 957) |
| AT3-751 Target: | 5'-AGCCCCUGGACUUCAAGGAAAAUGC-3'<br>3'-GGUCGGGGACCUGAAGUUCCUUUUACG-5'<br>5'-CCAGCCCCTGGACTTCAAGGAAAATGC-3' | (SEQ ID NO: 1342)<br>(SEQ ID NO: 574)<br>(SEQ ID NO: 958) |
| AT3-752 Target: | 5'-GCCCCUGGACUUCAAGGAAAAUGCA-3'<br>3'-GUCGGGGACCUGAAGUUCCUUUUACGU-5'<br>5'-CAGCCCCTGGACTTCAAGGAAAATGCA-3' | (SEQ ID NO: 1343)<br>(SEQ ID NO: 575)<br>(SEQ ID NO: 959) |
| AT3-757 Target: | 5'-UGGACUUCAAGGAAAAUGCAGAGCA-3'<br>3'-GGACCUGAAGUUCCUUUUACGUCUCGU-5'<br>5'-CCTGGACTTCAAGGAAAATGCAGAGCA-3' | (SEQ ID NO: 1344)<br>(SEQ ID NO: 576)<br>(SEQ ID NO: 960) |
| AT3-758 Target: | 5'-GGACUUCAAGGAAAAUGCAGAGCAA-3'<br>3'-GACCUGAAGUUCCUUUUACGUCUCGUU-5'<br>5'-CTGGACTTCAAGGAAAATGCAGAGCAA-3' | (SEQ ID NO: 1345)<br>(SEQ ID NO: 577)<br>(SEQ ID NO: 961) |
| AT3-759 Target: | 5'-GACUUCAAGGAAAAUGCAGAGCAAU-3'<br>3'-ACCUGAAGUUCCUUUUACGUCUCGUUA-5'<br>5'-TGGACTTCAAGGAAAATGCAGAGCAAT-3' | (SEQ ID NO: 1346)<br>(SEQ ID NO: 578)<br>(SEQ ID NO: 962) |
| AT3-760 Target: | 5'-ACUUCAAGGAAAAUGCAGAGCAAUC-3'<br>3'-CCUGAAGUUCCUUUUACGUCUCGUUAG-5'<br>5'-GGACTTCAAGGAAAATGCAGAGCAATC-3' | (SEQ ID NO: 1347)<br>(SEQ ID NO: 579)<br>(SEQ ID NO: 963) |
| AT3-762 Target: | 5'-UUCAAGGAAAAUGCAGAGCAAUCCA-3'<br>3'-UGAAGUUCCUUUUACGUCUCGUUAGGU-5'<br>5'-ACTTCAAGGAAAATGCAGAGCAATCCA-3' | (SEQ ID NO: 1348)<br>(SEQ ID NO: 580)<br>(SEQ ID NO: 964) |
| AT3-763 Target: | 5'-UCAAGGAAAAUGCAGAGCAAUCCAG-3'<br>3'-GAAGUUCCUUUUACGUCUCGUUAGGUC-5'<br>5'-CTTCAAGGAAAATGCAGAGCAATCCAG-3' | (SEQ ID NO: 1349)<br>(SEQ ID NO: 581)<br>(SEQ ID NO: 965) |
| AT3-764 Target: | 5'-CAAGGAAAAUGCAGAGCAAUCCAGA-3'<br>3'-AAGUUCCUUUUACGUCUCGUUAGGUCU-5'<br>5'-TTCAAGGAAAATGCAGAGCAATCCAGA-3' | (SEQ ID NO: 1350)<br>(SEQ ID NO: 582)<br>(SEQ ID NO: 966) |
| AT3-765 Target: | 5'-AAGGAAAAUGCAGAGCAAUCCAGAG-3'<br>3'-AGUUCCUUUUACGUCUCGUUAGGUCUC-5'<br>5'-TCAAGGAAAATGCAGAGCAATCCAGAG-3' | (SEQ ID NO: 1351)<br>(SEQ ID NO: 583)<br>(SEQ ID NO: 967) |
| AT3-794 Target: | 5'-CAUCAACAAAUGGGUGUCCAAUAAG-3'<br>3'-CGGUAGUUGUUUACCCACAGGUUAUUC-5'<br>5'-GCCATCAACAAATGGGTGTCCAATAAG-3' | (SEQ ID NO: 1352)<br>(SEQ ID NO: 584)<br>(SEQ ID NO: 968) |
| AT3-795 Target: | 5'-AUCAACAAAUGGGUGUCCAAUAAGA-3'<br>3'-GGUAGUUGUUUACCCACAGGUUAUUCU-5'<br>5'-CCATCAACAAATGGGTGTCCAATAAGA-3' | (SEQ ID NO: 1353)<br>(SEQ ID NO: 585)<br>(SEQ ID NO: 969) |
| AT3-800 Target: | 5'-CAAAUGGGUGUCCAAUAAGACCGAA-3'<br>3'-UUGUUUACCCACAGGUUAUUCUGGCUU-5'<br>5'-AACAAATGGGTGTCCAATAAGACCGAA-3' | (SEQ ID NO: 1354)<br>(SEQ ID NO: 586)<br>(SEQ ID NO: 970) |
| AT3-864 Target: | 5'-GAGCUCACUGUUCUGGUGCUGGUUA-3'<br>3'-UACUCGAGUGACAAGACCACGACCAAU-5'<br>5'-ATGAGCTCACTGTTCTGGTGCTGGTTA-3' | (SEQ ID NO: 1355)<br>(SEQ ID NO: 587)<br>(SEQ ID NO: 971) |
| AT3-866 Target: | 5'-GCUCACUGUUCUGGUGCUGGUUAAC-3'<br>3'-CUCGAGUGACAAGACCACGACCAAUUG-5'<br>5'-GAGCTCACTGTTCTGGTGCTGGTTAAC-3' | (SEQ ID NO: 1356)<br>(SEQ ID NO: 588)<br>(SEQ ID NO: 972) |
| AT3-867 Target: | 5'-CUCACUGUUCUGGUGCUGGUUAACA-3'<br>3'-UCGAGUGACAAGACCACGACCAAUUGU-5'<br>5'-AGCTCACTGTTCTGGTGCTGGTTAACA-3' | (SEQ ID NO: 1357)<br>(SEQ ID NO: 589)<br>(SEQ ID NO: 973) |
| AT3-868 Target: | 5'-UCACUGUUCUGGUGCUGGUUAACAC-3'<br>3'-CGAGUGACAAGACCACGACCAAUUGUG-5'<br>5'-GCTCACTGTTCTGGTGCTGGTTAACAC-3' | (SEQ ID NO: 1358)<br>(SEQ ID NO: 590)<br>(SEQ ID NO: 974) |
| AT3-869 Target: | 5'-CACUGUUCUGGUGCUGGUUAACACC-3'<br>3'-GAGUGACAAGACCACGACCAAUUGUGG-5'<br>5'-CTCACTGTTCTGGTGCTGGTTAACACC-3' | (SEQ ID NO: 1359)<br>(SEQ ID NO: 591)<br>(SEQ ID NO: 975) |

TABLE 3-continued

Selected Human Anti-AT3 DsiRNAs, Unmodified Duplexes (Asymmetries)

| | | | |
|---|---|---|---|
| AT3-870 | Target: | 5'-ACUGUUCUGGUGCUGGUUAACACCA-3'<br>3'-AGUGACAAGACCACGACCAAUUGUGGU-5'<br>5'-TCACTGTTCTGGTGCTGGTTAACACCA-3' | (SEQ ID NO: 1360)<br>(SEQ ID NO: 592)<br>(SEQ ID NO: 976) |
| AT3-871 | Target: | 5'-CUGUUCUGGUGCUGGUUAACACCAU-3'<br>3'-GUGACAAGACCACGACCAAUUGUGGUA-5'<br>5'-CACTGTTCTGGTGCTGGTTAACACCAT-3' | (SEQ ID NO: 1361)<br>(SEQ ID NO: 593)<br>(SEQ ID NO: 977) |
| AT3-872 | Target: | 5'-UGUUCUGGUGCUGGUUAACACCAUU-3'<br>3'-UGACAAGACCACGACCAAUUGUGGUAA-5'<br>5'-ACTGTTCTGGTGCTGGTTAACACCATT-3' | (SEQ ID NO: 1362)<br>(SEQ ID NO: 594)<br>(SEQ ID NO: 978) |
| AT3-873 | Target: | 5'-GUUCUGGUGCUGGUUAACACCAUUU-3'<br>3'-GACAAGACCACGACCAAUUGUGGUAAA-5'<br>5'-CTGTTCTGGTGCTGGTTAACACCATTT-3' | (SEQ ID NO: 1363)<br>(SEQ ID NO: 595)<br>(SEQ ID NO: 979) |
| AT3-874 | Target: | 5'-UUCUGGUGCUGGUUAACACCAUUUA-3'<br>3'-ACAAGACCACGACCAAUUGUGGUAAAU-5'<br>5'-TGTTCTGGTGCTGGTTAACACCATTTA-3' | (SEQ ID NO: 1364)<br>(SEQ ID NO: 596)<br>(SEQ ID NO: 980) |
| AT3-875 | Target: | 5'-UCUGGUGCUGGUUAACACCAUUUAC-3'<br>3'-CAAGACCACGACCAAUUGUGGUAAAUG-5'<br>5'-GTTCTGGTGCTGGTTAACACCATTTAC-3' | (SEQ ID NO: 1365)<br>(SEQ ID NO: 597)<br>(SEQ ID NO: 981) |
| AT3-876 | Target: | 5'-CUGGUGCUGGUUAACACCAUUUACU-3'<br>3'-AAGACCACGACCAAUUGUGGUAAAUGA-5'<br>5'-TTCTGGTGCTGGTTAACACCATTTACT-3' | (SEQ ID NO: 1366)<br>(SEQ ID NO: 598)<br>(SEQ ID NO: 982) |
| AT3-877 | Target: | 5'-UGGUGCUGGUUAACACCAUUUACUU-3'<br>3'-AGACCACGACCAAUUGUGGUAAAUGAA-5'<br>5'-TCTGGTGCTGGTTAACACCATTTACTT-3' | (SEQ ID NO: 1367)<br>(SEQ ID NO: 599)<br>(SEQ ID NO: 983) |
| AT3-878 | Target: | 5'-GGUGCUGGUUAACACCAUUUACUUC-3'<br>3'-GACCACGACCAAUUGUGGUAAAUGAAG-5'<br>5'-CTGGTGCTGGTTAACACCATTTACTTC-3' | (SEQ ID NO: 1368)<br>(SEQ ID NO: 600)<br>(SEQ ID NO: 984) |
| AT3-879 | Target: | 5'-GUGCUGGUUAACACCAUUUACUUCA-3'<br>3'-ACCACGACCAAUUGUGGUAAAUGAAGU-5'<br>5'-TGGTGCTGGTTAACACCATTTACTTCA-3' | (SEQ ID NO: 1369)<br>(SEQ ID NO: 601)<br>(SEQ ID NO: 985) |
| AT3-880 | Target: | 5'-UGCUGGUUAACACCAUUUACUUCAA-3'<br>3'-CCACGACCAAUUGUGGUAAAUGAAGUU-5'<br>5'-GGTGCTGGTTAACACCATTTACTTCAA-3' | (SEQ ID NO: 1370)<br>(SEQ ID NO: 602)<br>(SEQ ID NO: 986) |
| AT3-881 | Target: | 5'-GCUGGUUAACACCAUUUACUUCAAG-3'<br>3'-CACGACCAAUUGUGGUAAAUGAAGUUC-5'<br>5'-GTGCTGGTTAACACCATTTACTTCAAG-3' | (SEQ ID NO: 1371)<br>(SEQ ID NO: 603)<br>(SEQ ID NO: 987) |
| AT3-882 | Target: | 5'-CUGGUUAACACCAUUUACUUCAAGG-3'<br>3'-ACGACCAAUUGUGGUAAAUGAAGUUCC-5'<br>5'-TGCTGGTTAACACCATTTACTTCAAGG-3' | (SEQ ID NO: 1372)<br>(SEQ ID NO: 604)<br>(SEQ ID NO: 988) |
| AT3-883 | Target: | 5'-UGGUUAACACCAUUUACUUCAAGGG-3'<br>3'-CGACCAAUUGUGGUAAAUGAAGUUCCC-5'<br>5'-GCTGGTTAACACCATTTACTTCAAGGG-3' | (SEQ ID NO: 1373)<br>(SEQ ID NO: 605)<br>(SEQ ID NO: 989) |
| AT3-884 | Target: | 5'-GGUUAACACCAUUUACUUCAAGGGC-3'<br>3'-GACCAAUUGUGGUAAAUGAAGUUCCCG-5'<br>5'-CTGGTTAACACCATTTACTTCAAGGGC-3' | (SEQ ID NO: 1374)<br>(SEQ ID NO: 606)<br>(SEQ ID NO: 990) |
| AT3-885 | Target: | 5'-GUUAACACCAUUUACUUCAAGGGCC-3'<br>3'-ACCAAUUGUGGUAAAUGAAGUUCCCGG-5'<br>5'-TGGTTAACACCATTTACTTCAAGGGCC-3' | (SEQ ID NO: 1375)<br>(SEQ ID NO: 607)<br>(SEQ ID NO: 991) |
| AT3-886 | Target: | 5'-UUAACACCAUUUACUUCAAGGGCCU-3'<br>3'-CCAAUUGUGGUAAAUGAAGUUCCCGGA-5'<br>5'-GGTTAACACCATTTACTTCAAGGGCCT-3' | (SEQ ID NO: 1376)<br>(SEQ ID NO: 608)<br>(SEQ ID NO: 992) |
| AT3-887 | Target: | 5'-UAACACCAUUUACUUCAAGGGCCUG-3'<br>3'-CAAUUGUGGUAAAUGAAGUUCCCGGAC-5'<br>5'-GTTAACACCATTTACTTCAAGGGCCTG-3' | (SEQ ID NO: 1377)<br>(SEQ ID NO: 609)<br>(SEQ ID NO: 993) |
| AT3-888 | Target: | 5'-AACACCAUUUACUUCAAGGGCCUGU-3'<br>3'-AAUUGUGGUAAAUGAAGUUCCCGGACA-5'<br>5'-TTAACACCATTTACTTCAAGGGCCTGT-3' | (SEQ ID NO: 1378)<br>(SEQ ID NO: 610)<br>(SEQ ID NO: 994) |

TABLE 3-continued

Selected Human Anti-AT3 DsiRNAs, Unmodified Duplexes (Asymmetries)

| | | |
|---|---|---|
| AT3-889 Target: | 5'-ACACCAUUUACUUCAAGGGCCUGUG-3'<br>3'-AUUGUGGUAAAUGAAGUUCCCGGACAC-5'<br>5'-TAACACCATTTACTTCAAGGGCCTGTG-3' | (SEQ ID NO: 1379)<br>(SEQ ID NO: 611)<br>(SEQ ID NO: 995) |
| AT3-890 Target: | 5'-CACCAUUUACUUCAAGGGCCUGUGG-3'<br>3'-UUGUGGUAAAUGAAGUUCCCGGACACC-5'<br>5'-AACACCATTTACTTCAAGGGCCTGTGG-3' | (SEQ ID NO: 1380)<br>(SEQ ID NO: 612)<br>(SEQ ID NO: 996) |
| AT3-891 Target: | 5'-ACCAUUUACUUCAAGGGCCUGUGGA-3'<br>3'-UGUGGUAAAUGAAGUUCCCGGACACCU-5'<br>5'-ACACCATTTACTTCAAGGGCCTGTGGA-3' | (SEQ ID NO: 1381)<br>(SEQ ID NO: 613)<br>(SEQ ID NO: 997) |
| AT3-892 Target: | 5'-CCAUUUACUUCAAGGGCCUGUGGAA-3'<br>3'-GUGGUAAAUGAAGUUCCCGGACACCUU-5'<br>5'-CACCATTTACTTCAAGGGCCTGTGGAA-3' | (SEQ ID NO: 1382)<br>(SEQ ID NO: 614)<br>(SEQ ID NO: 998) |
| AT3-893 Target: | 5'-CAUUUACUUCAAGGGCCUGUGGAAG-3'<br>3'-UGGUAAAUGAAGUUCCCGGACACCUUC-5'<br>5'-ACCATTTACTTCAAGGGCCTGTGGAAG-3' | (SEQ ID NO: 1383)<br>(SEQ ID NO: 615)<br>(SEQ ID NO: 999) |
| AT3-894 Target: | 5'-AUUUACUUCAAGGGCCUGUGGAAGU-3'<br>3'-GGUAAAUGAAGUUCCCGGACACCUUCA-5'<br>5'-CCATTTACTTCAAGGGCCTGTGGAAGT-3' | (SEQ ID NO: 1384)<br>(SEQ ID NO: 616)<br>(SEQ ID NO: 1000) |
| AT3-895 Target: | 5'-UUUACUUCAAGGGCCUGUGGAAGUC-3'<br>3'-GUAAAUGAAGUUCCCGGACACCUUCAG-5'<br>5'-CATTTACTTCAAGGGCCTGTGGAAGTC-3' | (SEQ ID NO: 1385)<br>(SEQ ID NO: 617)<br>(SEQ ID NO: 1001) |
| AT3-896 Target: | 5'-UUACUUCAAGGGCCUGUGGAAGUCA-3'<br>3'-UAAAUGAAGUUCCCGGACACCUUCAGU-5'<br>5'-ATTTACTTCAAGGGCCTGTGGAAGTCA-3' | (SEQ ID NO: 1386)<br>(SEQ ID NO: 618)<br>(SEQ ID NO: 1002) |
| AT3-897 Target: | 5'-UACUUCAAGGGCCUGUGGAAGUCAA-3'<br>3'-AAAUGAAGUUCCCGGACACCUUCAGUU-5'<br>5'-TTTACTTCAAGGGCCTGTGGAAGTCAA-3' | (SEQ ID NO: 1387)<br>(SEQ ID NO: 619)<br>(SEQ ID NO: 1003) |
| AT3-898 Target: | 5'-ACUUCAAGGGCCUGUGGAAGUCAAA-3'<br>3'-AAUGAAGUUCCCGGACACCUUCAGUUU-5'<br>5'-TTACTTCAAGGGCCTGTGGAAGTCAAA-3' | (SEQ ID NO: 1388)<br>(SEQ ID NO: 620)<br>(SEQ ID NO: 1004) |
| AT3-899 Target: | 5'-CUUCAAGGGCCUGUGGAAGUCAAAG-3'<br>3'-AUGAAGUUCCCGGACACCUUCAGUUUC-5'<br>5'-TACTTCAAGGGCCTGTGGAAGTCAAAG-3' | (SEQ ID NO: 1389)<br>(SEQ ID NO: 621)<br>(SEQ ID NO: 1005) |
| AT3-900 Target: | 5'-UUCAAGGGCCUGUGGAAGUCAAAGU-3'<br>3'-UGAAGUUCCCGGACACCUUCAGUUUCA-5'<br>5'-ACTTCAAGGGCCTGTGGAAGTCAAAGT-3' | (SEQ ID NO: 1390)<br>(SEQ ID NO: 622)<br>(SEQ ID NO: 1006) |
| AT3-901 Target: | 5'-UCAAGGGCCUGUGGAAGUCAAAGUU-3'<br>3'-GAAGUUCCCGGACACCUUCAGUUUCAA-5'<br>5'-CTTCAAGGGCCTGTGGAAGTCAAAGTT-3' | (SEQ ID NO: 1391)<br>(SEQ ID NO: 623)<br>(SEQ ID NO: 1007) |
| AT3-902 Target: | 5'-CAAGGGCCUGUGGAAGUCAAAGUUC-3'<br>3'-AAGUUCCCGGACACCUUCAGUUUCAAG-5'<br>5'-TTCAAGGGCCTGTGGAAGTCAAAGTTC-3' | (SEQ ID NO: 1392)<br>(SEQ ID NO: 624)<br>(SEQ ID NO: 1008) |
| AT3-903 Target: | 5'-AAGGGCCUGUGGAAGUCAAAGUUCA-3'<br>3'-AGUUCCCGGACACCUUCAGUUUCAAGU-5'<br>5'-TCAAGGGCCTGTGGAAGTCAAAGTTCA-3' | (SEQ ID NO: 1393)<br>(SEQ ID NO: 625)<br>(SEQ ID NO: 1009) |
| AT3-904 Target: | 5'-AGGGCCUGUGGAAGUCAAAGUUCAG-3'<br>3'-GUUCCCGGACACCUUCAGUUUCAAGUC-5'<br>5'-CAAGGGCCTGTGGAAGTCAAAGTTCAG-3' | (SEQ ID NO: 1394)<br>(SEQ ID NO: 626)<br>(SEQ ID NO: 1010) |
| AT3-905 Target: | 5'-GGGCCUGUGGAAGUCAAAGUUCAGC-3'<br>3'-UUCCCGGACACCUUCAGUUUCAAGUCG-5'<br>5'-AAGGGCCTGTGGAAGTCAAAGTTCAGC-3' | (SEQ ID NO: 1395)<br>(SEQ ID NO: 627)<br>(SEQ ID NO: 1011) |
| AT3-906 Target: | 5'-GGCCUGUGGAAGUCAAAGUUCAGCC-3'<br>3'-UCCCGGACACCUUCAGUUUCAAGUCGG-5'<br>5'-AGGGCCTGTGGAAGTCAAAGTTCAGCC-3' | (SEQ ID NO: 1396)<br>(SEQ ID NO: 628)<br>(SEQ ID NO: 1012) |
| AT3-907 Target: | 5'-GCCUGUGGAAGUCAAAGUUCAGCCC-3'<br>3'-CCCGGACACCUUCAGUUUCAAGUCGGG-5'<br>5'-GGGCCTGTGGAAGTCAAAGTTCAGCCC-3' | (SEQ ID NO: 1397)<br>(SEQ ID NO: 629)<br>(SEQ ID NO: 1013) |

TABLE 3-continued

Selected Human Anti-AT3 DsiRNAs, Unmodified Duplexes (Asymmetries)

| | | |
|---|---|---|
| AT3-908 Target: | 5'-CCUGUGGAAGUCAAAGUUCAGCCCU-3'<br>3'-CCGGACACCUUCAGUUUCAAGUCGGGA-5'<br>5'-GGCCTGTGGAAGTCAAAGTTCAGCCCT-3' | (SEQ ID NO: 1398)<br>(SEQ ID NO: 630)<br>(SEQ ID NO: 1014) |
| AT3-909 Target: | 5'-CUGUGGAAGUCAAAGUUCAGCCCUG-3'<br>3'-CGGACACCUUCAGUUUCAAGUCGGGAC-5'<br>5'-GCCTGTGGAAGTCAAAGTTCAGCCCTG-3' | (SEQ ID NO: 1399)<br>(SEQ ID NO: 631)<br>(SEQ ID NO: 1015) |
| AT3-910 Target: | 5'-UGUGGAAGUCAAAGUUCAGCCCUGA-3'<br>3'-GGACACCUUCAGUUUCAAGUCGGGACU-5'<br>5'-CCTGTGGAAGTCAAAGTTCAGCCCTGA-3' | (SEQ ID NO: 1400)<br>(SEQ ID NO: 632)<br>(SEQ ID NO: 1016) |
| AT3-911 Target: | 5'-GUGGAAGUCAAAGUUCAGCCCUGAG-3'<br>3'-GACACCUUCAGUUUCAAGUCGGGACUC-5'<br>5'-CTGTGGAAGTCAAAGTTCAGCCCTGAG-3' | (SEQ ID NO: 1401)<br>(SEQ ID NO: 633)<br>(SEQ ID NO: 1017) |
| AT3-912 Target: | 5'-UGGAAGUCAAAGUUCAGCCCUGAGA-3'<br>3'-ACACCUUCAGUUUCAAGUCGGGACUCU-5'<br>5'-TGTGGAAGTCAAAGTTCAGCCCTGAGA-3' | (SEQ ID NO: 1402)<br>(SEQ ID NO: 634)<br>(SEQ ID NO: 1018) |
| AT3-913 Target: | 5'-GGAAGUCAAAGUUCAGCCCUGAGAA-3'<br>3'-CACCUUCAGUUUCAAGUCGGGACUCUU-5'<br>5'-GTGGAAGTCAAAGTTCAGCCCTGAGAA-3' | (SEQ ID NO: 1403)<br>(SEQ ID NO: 635)<br>(SEQ ID NO: 1019) |
| AT3-914 Target: | 5'-GAAGUCAAAGUUCAGCCCUGAGAAC-3'<br>3'-ACCUUCAGUUUCAAGUCGGGACUCUUG-5'<br>5'-TGGAAGTCAAAGTTCAGCCCTGAGAAC-3' | (SEQ ID NO: 1404)<br>(SEQ ID NO: 636)<br>(SEQ ID NO: 1020) |
| AT3-915 Target: | 5'-AAGUCAAAGUUCAGCCCUGAGAACA-3'<br>3'-CCUUCAGUUUCAAGUCGGGACUCUUGU-5'<br>5'-GGAAGTCAAAGTTCAGCCCTGAGAACA-3' | (SEQ ID NO: 1405)<br>(SEQ ID NO: 637)<br>(SEQ ID NO: 1021) |
| AT3-916 Target: | 5'-AGUCAAAGUUCAGCCCUGAGAACAC-3'<br>3'-CUUCAGUUUCAAGUCGGGACUCUUGUG-5'<br>5'-GAAGTCAAAGTTCAGCCCTGAGAACAC-3' | (SEQ ID NO: 1406)<br>(SEQ ID NO: 638)<br>(SEQ ID NO: 1022) |
| AT3-959 Target: | 5'-CAAGGCUGAUGGAGAGUCGUGUUCA-3'<br>3'-AUGUUCCGACUACCUCUCAGCACAAGU-5'<br>5'-TACAAGGCTGATGGAGAGTCGTGTTCA-3' | (SEQ ID NO: 1407)<br>(SEQ ID NO: 639)<br>(SEQ ID NO: 1023) |
| AT3-966 Target: | 5'-GAUGGAGAGUCGUGUUCAGCAUCUA-3'<br>3'-GACUACCUCUCAGCACAAGUCGUAGAU-5'<br>5'-CTGATGGAGAGTCGTGTTCAGCATCTA-3' | (SEQ ID NO: 1408)<br>(SEQ ID NO: 640)<br>(SEQ ID NO: 1024) |
| AT3-967 Target: | 5'-AUGGAGAGUCGUGUUCAGCAUCUAU-3'<br>3'-ACUACCUCUCAGCACAAGUCGUAGAUA-5'<br>5'-TGATGGAGAGTCGTGTTCAGCATCTAT-3' | (SEQ ID NO: 1409)<br>(SEQ ID NO: 641)<br>(SEQ ID NO: 1025) |
| AT3-988 Target: | 5'-CUAUGAUGUACCAGGAAGGCAAGUU-3'<br>3'-UAGAUACUACAUGGUCCUUCCGUUCAA-5'<br>5'-ATCTATGATGTACCAGGAAGGCAAGTT-3' | (SEQ ID NO: 1410)<br>(SEQ ID NO: 642)<br>(SEQ ID NO: 1026) |
| AT3-989 Target: | 5'-UAUGAUGUACCAGGAAGGCAAGUUC-3'<br>3'-AGAUACUACAUGGUCCUUCCGUUCAAG-5'<br>5'-TCTATGATGTACCAGGAAGGCAAGTTC-3' | (SEQ ID NO: 1411)<br>(SEQ ID NO: 643)<br>(SEQ ID NO: 1027) |
| AT3-990 Target: | 5'-AUGAUGUACCAGGAAGGCAAGUUCC-3'<br>3'-GAUACUACAUGGUCCUUCCGUUCAAGG-5'<br>5'-CTATGATGTACCAGGAAGGCAAGTTCC-3' | (SEQ ID NO: 1412)<br>(SEQ ID NO: 644)<br>(SEQ ID NO: 1028) |
| AT3-991 Target: | 5'-UGAUGUACCAGGAAGGCAAGUUCCG-3'<br>3'-AUACUACAUGGUCCUUCCGUUCAAGGC-5'<br>5'-TATGATGTACCAGGAAGGCAAGTTCCG-3' | (SEQ ID NO: 1413)<br>(SEQ ID NO: 645)<br>(SEQ ID NO: 1029) |
| AT3-993 Target: | 5'-AUGUACCAGGAAGGCAAGUUCCGUU-3'<br>3'-ACUACAUGGUCCUUCCGUUCAAGGCAA-5'<br>5'-TGATGTACCAGGAAGGCAAGTTCCGTT-3' | (SEQ ID NO: 1414)<br>(SEQ ID NO: 646)<br>(SEQ ID NO: 1030) |
| AT3-1040 Target: | 5'-CCAGGUGCUUGAGUUGCCCUUCAAA-3'<br>3'-UGGGUCCACGAACUCAACGGGAAGUUU-5'<br>5'-ACCCAGGTGCTTGAGTTGCCCTTCAAA-3' | (SEQ ID NO: 1415)<br>(SEQ ID NO: 647)<br>(SEQ ID NO: 1031) |
| AT3-1043 Target: | 5'-GGUGCUUGAGUUGCCCUUCAAAGGU-3'<br>3'-GUCCACGAACUCAACGGGAAGUUUCCA-5'<br>5'-CAGGTGCTTGAGTTGCCCTTCAAAGGT-3' | (SEQ ID NO: 1416)<br>(SEQ ID NO: 648)<br>(SEQ ID NO: 1032) |

TABLE 3-continued

Selected Human Anti-AT3 DsiRNAs, Unmodified Duplexes (Asymmetries)

```
                    5'-GUGCUUGAGUUGCCCUUCAAAGGUG-3'        (SEQ ID NO: 1417)
                    3'-UCCACGAACUCAACGGGAAGUUUCCAC-5'      (SEQ ID NO: 649)
AT3-1044  Target:   5'-AGGTGCTTGAGTTGCCCTTCAAAGGTG-3'      (SEQ ID NO: 1033)

5'-UGCUUGAGUUGCCCUUCAAAGGUGA-3'        (SEQ ID NO: 1418)
                    3'-CCACGAACUCAACGGGAAGUUUCCACU-5'      (SEQ ID NO: 650)
AT3-1045  Target:   5'-GGTGCTTGAGTTGCCCTTCAAAGGTGA-3'      (SEQ ID NO: 1034)

5'-GGUGAUGACAUCACCAUGGUCCUCA-3'        (SEQ ID NO: 1419)
                    3'-UUCCACUACUGUAGUGGUACCAGGAGU-5'      (SEQ ID NO: 651)
AT3-1065  Target:   5'-AAGGTGATGACATCACCATGGTCCTCA-3'      (SEQ ID NO: 1035)

5'-GUGAUGACAUCACCAUGGUCCUCAU-3'        (SEQ ID NO: 1420)
                    3'-UCCACUACUGUAGUGGUACCAGGAGUA-5'      (SEQ ID NO: 652)
AT3-1066  Target:   5'-AGGTGATGACATCACCATGGTCCTCAT-3'      (SEQ ID NO: 1036)

5'-UGCCCAAGCCUGAGAAGAGCCUGGC-3'        (SEQ ID NO: 1421)
                    3'-GAACGGGUUCGGACUCUUCUCGGACCG-5'      (SEQ ID NO: 653)
AT3-1093  Target:   5'-CTTGCCCAAGCCTGAGAAGAGCCTGGC-3'      (SEQ ID NO: 1037)

5'-GCCCAAGCCUGAGAAGAGCCUGGCC-3'        (SEQ ID NO: 1422)
                    3'-AACGGGUUCGGACUCUUCUCGGACCGG-5'      (SEQ ID NO: 654)
AT3-1094  Target:   5'-TTGCCCAAGCCTGAGAAGAGCCTGGCC-3'      (SEQ ID NO: 1038)

5'-CCCAAGCCUGAGAAGAGCCUGGCCA-3'        (SEQ ID NO: 1423)
                    3'-ACGGGUUCGGACUCUUCUCGGACCGGU-5'      (SEQ ID NO: 655)
AT3-1095  Target:   5'-TGCCCAAGCCTGAGAAGAGCCTGGCCA-3'      (SEQ ID NO: 1039)

5'-CCAAGCCUGAGAAGAGCCUGGCCAA-3'        (SEQ ID NO: 1424)
                    3'-CGGGUUCGGACUCUUCUCGGACCGGUU-5'      (SEQ ID NO: 656)
AT3-1096  Target:   5'-GCCCAAGCCTGAGAAGAGCCTGGCCAA-3'      (SEQ ID NO: 1040)

5'-CAAGCCUGAGAAGAGCCUGGCCAAG-3'        (SEQ ID NO: 1425)
                    3'-GGGUUCGGACUCUUCUCGGACCGGUUC-5'      (SEQ ID NO: 657)
AT3-1097  Target:   5'-CCCAAGCCTGAGAAGAGCCTGGCCAAG-3'      (SEQ ID NO: 1041)

5'-AAGCCUGAGAAGAGCCUGGCCAAGG-3'        (SEQ ID NO: 1426)
                    3'-GGUUCGGACUCUUCUCGGACCGGUUCC-5'      (SEQ ID NO: 658)
AT3-1098  Target:   5'-CCAAGCCTGAGAAGAGCCTGGCCAAGG-3'      (SEQ ID NO: 1042)

5'-AGCCUGAGAAGAGCCUGGCCAAGGU-3'        (SEQ ID NO: 1427)
                    3'-GUUCGGACUCUUCUCGGACCGGUUCCA-5'      (SEQ ID NO: 659)
AT3-1099  Target:   5'-CAAGCCTGAGAAGAGCCTGGCCAAGGT-3'      (SEQ ID NO: 1043)

5'-GCCUGAGAAGAGCCUGGCCAAGGUA-3'        (SEQ ID NO: 1428)
                    3'-UUCGGACUCUUCUCGGACCGGUUCCAU-5'      (SEQ ID NO: 660)
AT3-1100  Target:   5'-AAGCCTGAGAAGAGCCTGGCCAAGGTA-3'      (SEQ ID NO: 1044)

5'-CCUGAGAAGAGCCUGGCCAAGGUAG-3'        (SEQ ID NO: 1429)
                    3'-UCGGACUCUUCUCGGACCGGUUCCAUC-5'      (SEQ ID NO: 661)
AT3-1101  Target:   5'-AGCCTGAGAAGAGCCTGGCCAAGGTAG-3'      (SEQ ID NO: 1045)

5'-CUGAGAAGAGCCUGGCCAAGGUAGA-3'        (SEQ ID NO: 1430)
                    3'-CGGACUCUUCUCGGACCGGUUCCAUCU-5'      (SEQ ID NO: 662)
AT3-1102  Target:   5'-GCCTGAGAAGAGCCTGGCCAAGGTAGA-3'      (SEQ ID NO: 1046)

5'-UGAGAAGAGCCUGGCCAAGGUAGAG-3'        (SEQ ID NO: 1431)
                    3'-GGACUCUUCUCGGACCGGUUCCAUCUC-5'      (SEQ ID NO: 663)
AT3-1103  Target:   5'-CCTGAGAAGAGCCTGGCCAAGGTAGAG-3'      (SEQ ID NO: 1047)

5'-GAGAAGAGCCUGGCCAAGGUAGAGA-3'        (SEQ ID NO: 1432)
                    3'-GACUCUUCUCGGACCGGUUCCAUCUCU-5'      (SEQ ID NO: 664)
AT3-1104  Target:   5'-CTGAGAAGAGCCTGGCCAAGGTAGAGA-3'      (SEQ ID NO: 1048)

5'-AGAAGAGCCUGGCCAAGGUAGAGAA-3'        (SEQ ID NO: 1433)
                    3'-ACUCUUCUCGGACCGGUUCCAUCUCUU-5'      (SEQ ID NO: 665)
AT3-1105  Target:   5'-TGAGAAGAGCCTGGCCAAGGTAGAGAA-3'      (SEQ ID NO: 1049)

5'-GUGGUCCACAUGCCCCGCUUCCGCA-3'        (SEQ ID NO: 1434)
                    3'-ACCACCAGGUGUACGGGGCGAAGGCGU-5'      (SEQ ID NO: 666)
AT3-1188  Target:   5'-TGGTGGTCCACATGCCCCGCTTCCGCA-3'      (SEQ ID NO: 1050)

5'-UGGUCCACAUGCCCCGCUUCCGCAU-3'        (SEQ ID NO: 1435)
                    3'-CCACCAGGUGUACGGGGCGAAGGCGUA-5'      (SEQ ID NO: 667)
AT3-1189  Target:   5'-GGTGGTCCACATGCCCCGCTTCCGCAT-3'      (SEQ ID NO: 1051)
```

TABLE 3-continued

Selected Human Anti-AT3 DsiRNAs, Unmodified Duplexes (Asymmetries)

```
                 5'-GGUCCACAUGCCCCGCUUCCGCAUU-3'      (SEQ ID NO: 1436)
                 3'-CACCAGGUGUACGGGGCGAAGGCGUAA-5'    (SEQ ID NO: 668)
AT3-1190 Target: 5'-GTGGTCCACATGCCCCGCTTCCGCATT-3'    (SEQ ID NO: 1052)

5'-GUCCACAUGCCCCGCUUCCGCAUUG-3'      (SEQ ID NO: 1437)
                 3'-ACCAGGUGUACGGGGCGAAGGCGUAAC-5'    (SEQ ID NO: 669)
AT3-1191 Target: 5'-TGGTCCACATGCCCCGCTTCCGCATTG-3'    (SEQ ID NO: 1053)

5'-UCCACAUGCCCCGCUUCCGCAUUGA-3'      (SEQ ID NO: 1438)
                 3'-CCAGGUGUACGGGGCGAAGGCGUAACU-5'    (SEQ ID NO: 670)
AT3-1192 Target: 5'-GGTCCACATGCCCCGCTTCCGCATTGA-3'    (SEQ ID NO: 1054)

5'-CCACAUGCCCCGCUUCCGCAUUGAG-3'      (SEQ ID NO: 1439)
                 3'-CAGGUGUACGGGGCGAAGGCGUAACUC-5'    (SEQ ID NO: 671)
AT3-1193 Target: 5'-GTCCACATGCCCCGCTTCCGCATTGAG-3'    (SEQ ID NO: 1055)

5'-CACAUGCCCCGCUUCCGCAUUGAGG-3'      (SEQ ID NO: 1440)
                 3'-AGGUGUACGGGGCGAAGGCGUAACUCC-5'    (SEQ ID NO: 672)
AT3-1194 Target: 5'-TCCACATGCCCCGCTTCCGCATTGAGG-3'    (SEQ ID NO: 1056)

5'-AGUUUGAAGGAGCAGCUGCAAGACA-3'      (SEQ ID NO: 1441)
                 3'-AGUCAAACUUCCUCGUCGACGUUCUGU-5'    (SEQ ID NO: 673)
AT3-1227 Target: 5'-TCAGTTTGAAGGAGCAGCTGCAAGACA-3'    (SEQ ID NO: 1057)

5'-GUUUGAAGGAGCAGCUGCAAGACAU-3'      (SEQ ID NO: 1442)
                 3'-GUCAAACUUCCUCGUCGACGUUCUGUA-5'    (SEQ ID NO: 674)
AT3-1228 Target: 5'-CAGTTTGAAGGAGCAGCTGCAAGACAT-3'    (SEQ ID NO: 1058)

5'-UGAAGGAGCAGCUGCAAGACAUGGG-3'      (SEQ ID NO: 1443)
                 3'-AAACUUCCUCGUCGACGUUCUGUACCC-5'    (SEQ ID NO: 675)
AT3-1231 Target: 5'-TTTGAAGGAGCAGCTGCAAGACATGGG-3'    (SEQ ID NO: 1059)

5'-GAAGGAGCAGCUGCAAGACAUGGGC-3'      (SEQ ID NO: 1444)
                 3'-AACUUCCUCGUCGACGUUCUGUACCCG-5'    (SEQ ID NO: 676)
AT3-1232 Target: 5'-TTGAAGGAGCAGCTGCAAGACATGGGC-3'    (SEQ ID NO: 1060)

5'-AAGGAGCAGCUGCAAGACAUGGGCC-3'      (SEQ ID NO: 1445)
                 3'-ACUUCCUCGUCGACGUUCUGUACCCGG-5'    (SEQ ID NO: 677)
AT3-1233 Target: 5'-TGAAGGAGCAGCTGCAAGACATGGGCC-3'    (SEQ ID NO: 1061)

5'-AGGAGCAGCUGCAAGACAUGGGCCU-3'      (SEQ ID NO: 1446)
                 3'-CUUCCUCGUCGACGUUCUGUACCCGGA-5'    (SEQ ID NO: 678)
AT3-1234 Target: 5'-GAAGGAGCAGCTGCAAGACATGGGCCT-3'    (SEQ ID NO: 1062)

5'-GGAGCAGCUGCAAGACAUGGGCCUU-3'      (SEQ ID NO: 1447)
                 3'-UUCCUCGUCGACGUUCUGUACCCGGAA-5'    (SEQ ID NO: 679)
AT3-1235 Target: 5'-AAGGAGCAGCTGCAAGACATGGGCCTT-3'    (SEQ ID NO: 1063)

5'-GAGCAGCUGCAAGACAUGGGCCUUG-3'      (SEQ ID NO: 1448)
                 3'-UCCUCGUCGACGUUCUGUACCCGGAAC-5'    (SEQ ID NO: 680)
AT3-1236 Target: 5'-AGGAGCAGCTGCAAGACATGGGCCTTG-3'    (SEQ ID NO: 1064)

5'-AGCAGCUGCAAGACAUGGGCCUUGU-3'      (SEQ ID NO: 1449)
                 3'-CCUCGUCGACGUUCUGUACCCGGAACA-5'    (SEQ ID NO: 681)
AT3-1237 Target: 5'-GGAGCAGCTGCAAGACATGGGCCTTGT-3'    (SEQ ID NO: 1065)

5'-GCAGCUGCAAGACAUGGGCCUUGUC-3'      (SEQ ID NO: 1450)
                 3'-CUCGUCGACGUUCUGUACCCGGAACAG-5'    (SEQ ID NO: 682)
AT3-1238 Target: 5'-GAGCAGCTGCAAGACATGGGCCTTGTC-3'    (SEQ ID NO: 1066)

5'-CAGCUGCAAGACAUGGGCCUUGUCG-3'      (SEQ ID NO: 1451)
                 3'-UCGUCGACGUUCUGUACCCGGAACAGC-5'    (SEQ ID NO: 683)
AT3-1239 Target: 5'-AGCAGCTGCAAGACATGGGCCTTGTCG-3'    (SEQ ID NO: 1067)

5'-AGCUGCAAGACAUGGGCCUUGUCGA-3'      (SEQ ID NO: 1452)
                 3'-CGUCGACGUUCUGUACCCGGAACAGCU-5'    (SEQ ID NO: 684)
AT3-1240 Target: 5'-GCAGCTGCAAGACATGGGCCTTGTCGA-3'    (SEQ ID NO: 1068)

5'-UUGUCGAUCUGUUCAGCCCUGAAAA-3'      (SEQ ID NO: 1453)
                 3'-GGAACAGCUAGACAAGUCGGGACUUUU-5'    (SEQ ID NO: 685)
AT3-1258 Target: 5'-CCTTGTCGATCTGTTCAGCCCTGAAAA-3'    (SEQ ID NO: 1069)

5'-GUCGAUCUGUUCAGCCCUGAAAAGU-3'      (SEQ ID NO: 1454)
                 3'-AACAGCUAGACAAGUCGGGACUUUUCA-5'    (SEQ ID NO: 686)
AT3-1260 Target: 5'-TTGTCGATCTGTTCAGCCCTGAAAAGT-3'    (SEQ ID NO: 1070)
```

TABLE 3-continued

Selected Human Anti-AT3 DsiRNAs, Unmodified Duplexes (Asymmetries)

```
                     5'-UCGAUCUGUUCAGCCCUGAAAAGUC-3'      (SEQ ID NO: 1455)
                     3'-ACAGCUAGACAAGUCGGGACUUUUCAG-5'    (SEQ ID NO: 687)
AT3-1261 Target:     5'-TGTCGATCTGTTCAGCCCTGAAAAGTC-3'    (SEQ ID NO: 1071)

5'-GAUCUGUUCAGCCCUGAAAAGUCCA-3'      (SEQ ID NO: 1456)
                     3'-AGCUAGACAAGUCGGGACUUUUCAGGU-5'    (SEQ ID NO: 688)
AT3-1263 Target:     5'-TCGATCTGTTCAGCCCTGAAAAGTCCA-3'    (SEQ ID NO: 1072)

5'-CUGUUCAGCCCUGAAAAGUCCAAAC-3'      (SEQ ID NO: 1457)
                     3'-UAGACAAGUCGGGACUUUUCAGGUUUG-5'    (SEQ ID NO: 689)
AT3-1266 Target:     5'-ATCTGTTCAGCCCTGAAAAGTCCAAAC-3'    (SEQ ID NO: 1073)

5'-GUUCAGCCCUGAAAAGUCCAAACUC-3'      (SEQ ID NO: 1458)
                     3'-GACAAGUCGGGACUUUUCAGGUUUGAG-5'    (SEQ ID NO: 690)
AT3-1268 Target:     5'-CTGTTCAGCCCTGAAAAGTCCAAACTC-3'    (SEQ ID NO: 1074)

5'-AAAGUCCAAACUCCCAGGUAUUGUU-3'      (SEQ ID NO: 1459)
                     3'-CUUUUCAGGUUUGAGGGUCCAUAACAA-5'    (SEQ ID NO: 691)
AT3-1280 Target:     5'-GAAAAGTCCAAACTCCCAGGTATTGTT-3'    (SEQ ID NO: 1075)

5'-AAGUCCAAACUCCCAGGUAUUGUUG-3'      (SEQ ID NO: 1460)
                     3'-UUUUCAGGUUUGAGGGUCCAUAACAAC-5'    (SEQ ID NO: 692)
AT3-1281 Target:     5'-AAAAGTCCAAACTCCCAGGTATTGTTG-3'    (SEQ ID NO: 1076)

5'-GUCCAAACUCCCAGGUAUUGUUGCA-3'      (SEQ ID NO: 1461)
                     3'-UUCAGGUUUGAGGGUCCAUAACAACGU-5'    (SEQ ID NO: 693)
AT3-1283 Target:     5'-AAGTCCAAACTCCCAGGTATTGTTGCA-3'    (SEQ ID NO: 1077)

5'-CCAAACUCCCAGGUAUUGUUGCAGA-3'      (SEQ ID NO: 1462)
                     3'-CAGGUUUGAGGGUCCAUAACAACGUCU-5'    (SEQ ID NO: 694)
AT3-1285 Target:     5'-GTCCAAACTCCCAGGTATTGTTGCAGA-3'    (SEQ ID NO: 1078)

5'-CAAACUCCCAGGUAUUGUUGCAGAA-3'      (SEQ ID NO: 1463)
                     3'-AGGUUUGAGGGUCCAUAACAACGUCUU-5'    (SEQ ID NO: 695)
AT3-1286 Target:     5'-TCCAAACTCCCAGGTATTGTTGCAGAA-3'    (SEQ ID NO: 1079)

5'-AAACUCCCAGGUAUUGUUGCAGAAG-3'      (SEQ ID NO: 1464)
                     3'-GGUUUGAGGGUCCAUAACAACGUCUUC-5'    (SEQ ID NO: 696)
AT3-1287 Target:     5'-CCAAACTCCCAGGTATTGTTGCAGAAG-3'    (SEQ ID NO: 1080)

5'-AACUCCCAGGUAUUGUUGCAGAAGG-3'      (SEQ ID NO: 1465)
                     3'-GUUUGAGGGUCCAUAACAACGUCUUCC-5'    (SEQ ID NO: 697)
AT3-1288 Target:     5'-CAAACTCCCAGGTATTGTTGCAGAAGG-3'    (SEQ ID NO: 1081)

5'-CAUAAGGCAUUUCUUGAGGUAAAUG-3'      (SEQ ID NO: 1466)
                     3'-AGGUAUUCCGUAAAGAACUCCAUUUAC-5'    (SEQ ID NO: 698)
AT3-1344 Target:     5'-TCCATAAGGCATTTCTTGAGGTAAATG-3'    (SEQ ID NO: 1082)

5'-AUAAGGCAUUUCUUGAGGUAAAUGA-3'      (SEQ ID NO: 1467)
                     3'-GGUAUUCCGUAAAGAACUCCAUUUACU-5'    (SEQ ID NO: 699)
AT3-1345 Target:     5'-CCATAAGGCATTTCTTGAGGTAAATGA-3'    (SEQ ID NO: 1083)

5'-UAAGGCAUUUCUUGAGGUAAAUGAA-3'      (SEQ ID NO: 1468)
                     3'-GUAUUCCGUAAAGAACUCCAUUUACUU-5'    (SEQ ID NO: 700)
AT3-1346 Target:     5'-CATAAGGCATTTCTTGAGGTAAATGAA-3'    (SEQ ID NO: 1084)

5'-AAGGCAUUUCUUGAGGUAAAUGAAG-3'      (SEQ ID NO: 1469)
                     3'-UAUUCCGUAAAGAACUCCAUUUACUUC-5'    (SEQ ID NO: 701)
AT3-1347 Target:     5'-ATAAGGCATTTCTTGAGGTAAATGAAG-3'    (SEQ ID NO: 1085)

5'-AGGCAUUUCUUGAGGUAAAUGAAGA-3'      (SEQ ID NO: 1470)
                     3'-AUUCCGUAAAGAACUCCAUUUACUUCU-5'    (SEQ ID NO: 702)
AT3-1348 Target:     5'-TAAGGCATTTCTTGAGGTAAATGAAGA-3'    (SEQ ID NO: 1086)

5'-GGCAUUUCUUGAGGUAAAUGAAGAA-3'      (SEQ ID NO: 1471)
                     3'-UUCCGUAAAGAACUCCAUUUACUUCUU-5'    (SEQ ID NO: 703)
AT3-1349 Target:     5'-AAGGCATTTCTTGAGGTAAATGAAGAA-3'    (SEQ ID NO: 1087)

5'-GCAUUUCUUGAGGUAAAUGAAGAAG-3'      (SEQ ID NO: 1472)
                     3'-UCCGUAAAGAACUCCAUUUACUUCUUC-5'    (SEQ ID NO: 704)
AT3-1350 Target:     5'-AGGCATTTCTTGAGGTAAATGAAGAAG-3'    (SEQ ID NO: 1088)

5'-CAUUUCUUGAGGUAAAUGAAGAAGG-3'      (SEQ ID NO: 1473)
                     3'-CCGUAAAGAACUCCAUUUACUUCUUCC-5'    (SEQ ID NO: 705)
AT3-1351 Target:     5'-GGCATTTCTTGAGGTAAATGAAGAAGG-3'    (SEQ ID NO: 1089)
```

TABLE 3-continued

Selected Human Anti-AT3 DsiRNAs, Unmodified Duplexes (Asymmetries)

| | | | |
|---|---|---|---|
| AT3-1358 | Target: | 5'-UGAGGUAAAUGAAGAAGGCAGUGAA-3'<br>3'-GAACUCCAUUUACUUCUUCCGUCACUU-5'<br>5'-CTTGAGGTAAATGAAGAAGGCAGTGAA-3' | (SEQ ID NO: 1474)<br>(SEQ ID NO: 706)<br>(SEQ ID NO: 1090) |
| AT3-1359 | Target: | 5'-GAGGUAAAUGAAGAAGGCAGUGAAG-3'<br>3'-AACUCCAUUUACUUCUUCCGUCACUUC-5'<br>5'-TTGAGGTAAATGAAGAAGGCAGTGAAG-3' | (SEQ ID NO: 1475)<br>(SEQ ID NO: 707)<br>(SEQ ID NO: 1091) |
| AT3-1360 | Target: | 5'-AGGUAAAUGAAGAAGGCAGUGAAGC-3'<br>3'-ACUCCAUUUACUUCUUCCGUCACUUCG-5'<br>5'-TGAGGTAAATGAAGAAGGCAGTGAAGC-3' | (SEQ ID NO: 1476)<br>(SEQ ID NO: 708)<br>(SEQ ID NO: 1092) |
| AT3-1361 | Target: | 5'-GGUAAAUGAAGAAGGCAGUGAAGCA-3'<br>3'-CUCCAUUUACUUCUUCCGUCACUUCGU-5'<br>5'-GAGGTAAATGAAGAAGGCAGTGAAGCA-3' | (SEQ ID NO: 1477)<br>(SEQ ID NO: 709)<br>(SEQ ID NO: 1093) |
| AT3-1362 | Target: | 5'-GUAAAUGAAGAAGGCAGUGAAGCAG-3'<br>3'-UCCAUUUACUUCUUCCGUCACUUCGUC-5'<br>5'-AGGTAAATGAAGAAGGCAGTGAAGCAG-3' | (SEQ ID NO: 1478)<br>(SEQ ID NO: 710)<br>(SEQ ID NO: 1094) |
| AT3-1363 | Target: | 5'-UAAAUGAAGAAGGCAGUGAAGCAGC-3'<br>3'-CCAUUUACUUCUUCCGUCACUUCGUCG-5'<br>5'-GGTAAATGAAGAAGGCAGTGAAGCAGC-3' | (SEQ ID NO: 1479)<br>(SEQ ID NO: 711)<br>(SEQ ID NO: 1095) |
| AT3-1364 | Target: | 5'-AAAUGAAGAAGGCAGUGAAGCAGCU-3'<br>3'-CAUUUACUUCUUCCGUCACUUCGUCGA-5'<br>5'-GTAAATGAAGAAGGCAGTGAAGCAGCT-3' | (SEQ ID NO: 1480)<br>(SEQ ID NO: 712)<br>(SEQ ID NO: 1096) |
| AT3-1369 | Target: | 5'-AAGAAGGCAGUGAAGCAGCUGCAAG-3'<br>3'-ACUUCUUCCGUCACUUCGUCGACGUUC-5'<br>5'-TGAAGAAGGCAGTGAAGCAGCTGCAAG-3' | (SEQ ID NO: 1481)<br>(SEQ ID NO: 713)<br>(SEQ ID NO: 1097) |
| AT3-1372 | Target: | 5'-AAGGCAGUGAAGCAGCUGCAAGUAC-3'<br>3'-UCUUCCGUCACUUCGUCGACGUUCAUG-5'<br>5'-AGAAGGCAGTGAAGCAGCTGCAAGTAC-3' | (SEQ ID NO: 1482)<br>(SEQ ID NO: 714)<br>(SEQ ID NO: 1098) |
| AT3-1373 | Target: | 5'-AGGCAGUGAAGCAGCUGCAAGUACC-3'<br>3'-CUUCCGUCACUUCGUCGACGUUCAUGG-5'<br>5'-GAAGGCAGTGAAGCAGCTGCAAGTACC-3' | (SEQ ID NO: 1483)<br>(SEQ ID NO: 715)<br>(SEQ ID NO: 1099) |
| AT3-1381 | Target: | 5'-AAGCAGCUGCAAGUACCGCUGUUGU-3'<br>3'-ACUUCGUCGACGUUCAUGGCGACAACA-5'<br>5'-TGAAGCAGCTGCAAGTACCGCTGTTGT-3' | (SEQ ID NO: 1484)<br>(SEQ ID NO: 716)<br>(SEQ ID NO: 1100) |
| AT3-1452 | Target: | 5'-AACAGGCCUUUCCUGGUUUUUAUAA-3'<br>3'-GGUUGUCCGGAAAGGACCAAAAAUAUU-5'<br>5'-CCAACAGGCCTTTCCTGGTTTTTATAA-3' | (SEQ ID NO: 1485)<br>(SEQ ID NO: 717)<br>(SEQ ID NO: 1101) |
| AT3-1453 | Target: | 5'-ACAGGCCUUUCCUGGUUUUUAUAAG-3'<br>3'-GUUGUCCGGAAAGGACCAAAAAUAUUC-5'<br>5'-CAACAGGCCTTTCCTGGTTTTTATAAG-3' | (SEQ ID NO: 1486)<br>(SEQ ID NO: 718)<br>(SEQ ID NO: 1102) |
| AT3-1454 | Target: | 5'-CAGGCCUUUCCUGGUUUUUAUAAGA-3'<br>3'-UUGUCCGGAAAGGACCAAAAAUAUUCU-5'<br>5'-AACAGGCCTTTCCTGGTTTTTATAAGA-3' | (SEQ ID NO: 1487)<br>(SEQ ID NO: 719)<br>(SEQ ID NO: 1103) |
| AT3-1455 | Target: | 5'-AGGCCUUUCCUGGUUUUUAUAAGAG-3'<br>3'-UGUCCGGAAAGGACCAAAAAUAUUCUC-5'<br>5'-ACAGGCCTTTCCTGGTTTTTATAAGAG-3' | (SEQ ID NO: 1488)<br>(SEQ ID NO: 720)<br>(SEQ ID NO: 1104) |
| AT3-1456 | Target: | 5'-GGCCUUUCCUGGUUUUUAUAAGAGA-3'<br>3'-GUCCGGAAAGGACCAAAAAUAUUCUCU-5'<br>5'-CAGGCCTTTCCTGGTTTTTATAAGAGA-3' | (SEQ ID NO: 1489)<br>(SEQ ID NO: 721)<br>(SEQ ID NO: 1105) |
| AT3-1457 | Target: | 5'-GCCUUUCCUGGUUUUUAUAAGAGAA-3'<br>3'-UCCGGAAAGGACCAAAAAUAUUCUCUU-5'<br>5'-AGGCCTTTCCTGGTTTTTATAAGAGAA-3' | (SEQ ID NO: 1490)<br>(SEQ ID NO: 722)<br>(SEQ ID NO: 1106) |
| AT3-1459 | Target: | 5'-CUUUCCUGGUUUUUAUAAGAGAAGU-3'<br>3'-CGGAAAGGACCAAAAAUAUUCUCUUCA-5'<br>5'-GCCTTTCCTGGTTTTTATAAGAGAAGT-3' | (SEQ ID NO: 1491)<br>(SEQ ID NO: 723)<br>(SEQ ID NO: 1107) |
| AT3-1460 | Target: | 5'-UUUCCUGGUUUUUAUAAGAGAAGUU-3'<br>3'-GGAAAGGACCAAAAAUAUUCUCUUCAA-5'<br>5'-CCTTTCCTGGTTTTTATAAGAGAAGTT-3' | (SEQ ID NO: 1492)<br>(SEQ ID NO: 724)<br>(SEQ ID NO: 1108) |

TABLE 3-continued

Selected Human Anti-AT3 DsiRNAs, Unmodified Duplexes (Asymmetries)

|  |  |  |
|---|---|---|
| AT3-1461 Target: | 5'-UUCCUGGUUUUUAUAAGAGAAGUUC-3'<br>3'-GAAAGGACCAAAAAUAUUCUCUUCAAG-5'<br>5'-CTTTCCTGGTTTTTATAAGAGAAGTTC-3' | (SEQ ID NO: 1493)<br>(SEQ ID NO: 725)<br>(SEQ ID NO: 1109) |
| AT3-1462 Target: | 5'-UCCUGGUUUUUAUAAGAGAAGUUCC-3'<br>3'-AAAGGACCAAAAAUAUUCUCUUCAAGG-5'<br>5'-TTTCCTGGTTTTTATAAGAGAAGTTCC-3' | (SEQ ID NO: 1494)<br>(SEQ ID NO: 726)<br>(SEQ ID NO: 1110) |
| AT3-1463 Target: | 5'-CCUGGUUUUUAUAAGAGAAGUUCCU-3'<br>3'-AAGGACCAAAAAUAUUCUCUUCAAGGA-5'<br>5'-TTCCTGGTTTTTATAAGAGAAGTTCCT-3' | (SEQ ID NO: 1495)<br>(SEQ ID NO: 727)<br>(SEQ ID NO: 1111) |
| AT3-1464 Target: | 5'-CUGGUUUUUAUAAGAGAAGUUCCUC-3'<br>3'-AGGACCAAAAAUAUUCUCUUCAAGGAG-5'<br>5'-TCCTGGTTTTTATAAGAGAAGTTCCTC-3' | (SEQ ID NO: 1496)<br>(SEQ ID NO: 728)<br>(SEQ ID NO: 1112) |
| AT3-1465 Target: | 5'-UGGUUUUUAUAAGAGAAGUUCCUCU-3'<br>3'-GGACCAAAAAUAUUCUCUUCAAGGAGA-5'<br>5'-CCTGGTTTTTATAAGAGAAGTTCCTCT-3' | (SEQ ID NO: 1497)<br>(SEQ ID NO: 729)<br>(SEQ ID NO: 1113) |
| AT3-1466 Target: | 5'-GGUUUUUAUAAGAGAAGUUCCUCUG-3'<br>3'-GACCAAAAAUAUUCUCUUCAAGGAGAC-5'<br>5'-CTGGTTTTTATAAGAGAAGTTCCTCTG-3' | (SEQ ID NO: 1498)<br>(SEQ ID NO: 730)<br>(SEQ ID NO: 1114) |
| AT3-1467 Target: | 5'-GUUUUUAUAAGAGAAGUUCCUCUGA-3'<br>3'-ACCAAAAAUAUUCUCUUCAAGGAGACU-5'<br>5'-TGGTTTTTATAAGAGAAGTTCCTCTGA-3' | (SEQ ID NO: 1499)<br>(SEQ ID NO: 731)<br>(SEQ ID NO: 1115) |
| AT3-1468 Target: | 5'-UUUUUAUAAGAGAAGUUCCUCUGAA-3'<br>3'-CCAAAAAUAUUCUCUUCAAGGAGACUU-5'<br>5'-GGTTTTTATAAGAGAAGTTCCTCTGAA-3' | (SEQ ID NO: 1500)<br>(SEQ ID NO: 732)<br>(SEQ ID NO: 1116) |
| AT3-1469 Target: | 5'-UUUUAUAAGAGAAGUUCCUCUGAAC-3'<br>3'-CAAAAAUAUUCUCUUCAAGGAGACUUG-5'<br>5'-GTTTTTATAAGAGAAGTTCCTCTGAAC-3' | (SEQ ID NO: 1501)<br>(SEQ ID NO: 733)<br>(SEQ ID NO: 1117) |
| AT3-1470 Target: | 5'-UUUAUAAGAGAAGUUCCUCUGAACA-3'<br>3'-AAAAAUAUUCUCUUCAAGGAGACUUGU-5'<br>5'-TTTTTATAAGAGAAGTTCCTCTGAACA-3' | (SEQ ID NO: 1502)<br>(SEQ ID NO: 734)<br>(SEQ ID NO: 1118) |
| AT3-1471 Target: | 5'-UUAUAAGAGAAGUUCCUCUGAACAC-3'<br>3'-AAAAUAUUCUCUUCAAGGAGACUUGUG-5'<br>5'-TTTTATAAGAGAAGTTCCTCTGAACAC-3' | (SEQ ID NO: 1503)<br>(SEQ ID NO: 735)<br>(SEQ ID NO: 1119) |
| AT3-1472 Target: | 5'-UAUAAGAGAAGUUCCUCUGAACACU-3'<br>3'-AAAUAUUCUCUUCAAGGAGACUUGUGA-5'<br>5'-TTTATAAGAGAAGTTCCTCTGAACACT-3' | (SEQ ID NO: 1504)<br>(SEQ ID NO: 736)<br>(SEQ ID NO: 1120) |
| AT3-1473 Target: | 5'-AUAAGAGAAGUUCCUCUGAACACUA-3'<br>3'-AAUAUUCUCUUCAAGGAGACUUGUGAU-5'<br>5'-TTATAAGAGAAGTTCCTCTGAACACTA-3' | (SEQ ID NO: 1505)<br>(SEQ ID NO: 737)<br>(SEQ ID NO: 1121) |
| AT3-1474 Target: | 5'-UAAGAGAAGUUCCUCUGAACACUAU-3'<br>3'-AUAUUCUCUUCAAGGAGACUUGUGAUA-5'<br>5'-TATAAGAGAAGTTCCTCTGAACACTAT-3' | (SEQ ID NO: 1506)<br>(SEQ ID NO: 738)<br>(SEQ ID NO: 1122) |
| AT3-1475 Target: | 5'-AAGAGAAGUUCCUCUGAACACUAUU-3'<br>3'-UAUUCUCUUCAAGGAGACUUGUGAUAA-5'<br>5'-ATAAGAGAAGTTCCTCTGAACACTATT-3' | (SEQ ID NO: 1507)<br>(SEQ ID NO: 739)<br>(SEQ ID NO: 1123) |
| AT3-1476 Target: | 5'-AGAGAAGUUCCUCUGAACACUAUUA-3'<br>3'-AUUCUCUUCAAGGAGACUUGUGAUAAU-5'<br>5'-TAAGAGAAGTTCCTCTGAACACTATTA-3' | (SEQ ID NO: 1508)<br>(SEQ ID NO: 740)<br>(SEQ ID NO: 1124) |
| AT3-1477 Target: | 5'-GAGAAGUUCCUCUGAACACUAUUAU-3'<br>3'-UUCUCUUCAAGGAGACUUGUGAUAAUA-5'<br>5'-AAGAGAAGTTCCTCTGAACACTATTAT-3' | (SEQ ID NO: 1509)<br>(SEQ ID NO: 741)<br>(SEQ ID NO: 1125) |
| AT3-1478 Target: | 5'-AGAAGUUCCUCUGAACACUAUUAUC-3'<br>3'-UCUCUUCAAGGAGACUUGUGAUAAUAG-5'<br>5'-AGAGAAGTTCCTCTGAACACTATTATC-3' | (SEQ ID NO: 1510)<br>(SEQ ID NO: 742)<br>(SEQ ID NO: 1126) |
| AT3-1479 Target: | 5'-GAAGUUCCUCUGAACACUAUUAUCU-3'<br>3'-CUCUUCAAGGAGACUUGUGAUAAUAGA-5'<br>5'-GAGAAGTTCCTCTGAACACTATTATCT-3' | (SEQ ID NO: 1511)<br>(SEQ ID NO: 743)<br>(SEQ ID NO: 1127) |

TABLE 3-continued

Selected Human Anti-AT3 DsiRNAs, Unmodified Duplexes (Asymmetries)

|  |  |  |
|---|---|---|
|  | 5'-AAGUUCCUCUGAACACUAUUAUCUU-3' | (SEQ ID NO: 1512) |
|  | 3'-UCUUCAAGGAGACUUGUGAUAAUAGAA-5' | (SEQ ID NO: 744) |
| AT3-1480 Target: | 5'-AGAAGTTCCTCTGAACACTATTATCTT-3' | (SEQ ID NO: 1128) |
|  | 5'-AGUUCCUCUGAACACUAUUAUCUUC-3' | (SEQ ID NO: 1513) |
|  | 3'-CUUCAAGGAGACUUGUGAUAAUAGAAG-5' | (SEQ ID NO: 745) |
| AT3-1481 Target: | 5'-GAAGTTCCTCTGAACACTATTATCTTC-3' | (SEQ ID NO: 1129) |
|  | 5'-GUUCCUCUGAACACUAUUAUCUUCA-3' | (SEQ ID NO: 1514) |
|  | 3'-UUCAAGGAGACUUGUGAUAAUAGAAGU-5' | (SEQ ID NO: 746) |
| AT3-1482 Target: | 5'-AAGTTCCTCTGAACACTATTATCTTCA-3' | (SEQ ID NO: 1130) |
|  | 5'-UUCCUCUGAACACUAUUAUCUUCAU-3' | (SEQ ID NO: 1515) |
|  | 3'-UCAAGGAGACUUGUGAUAAUAGAAGUA-5' | (SEQ ID NO: 747) |
| AT3-1483 Target: | 5'-AGTTCCTCTGAACACTATTATCTTCAT-3' | (SEQ ID NO: 1131) |
|  | 5'-UCCUCUGAACACUAUUAUCUUCAUG-3' | (SEQ ID NO: 1516) |
|  | 3'-CAAGGAGACUUGUGAUAAUAGAAGUAC-5' | (SEQ ID NO: 748) |
| AT3-1484 Target: | 5'-GTTCCTCTGAACACTATTATCTTCATG-3' | (SEQ ID NO: 1132) |
|  | 5'-CCUCUGAACACUAUUAUCUUCAUGG-3' | (SEQ ID NO: 1517) |
|  | 3'-AAGGAGACUUGUGAUAAUAGAAGUACC-5' | (SEQ ID NO: 749) |
| AT3-1485 Target: | 5'-TTCCTCTGAACACTATTATCTTCATGG-3' | (SEQ ID NO: 1133) |
|  | 5'-CUCUGAACACUAUUAUCUUCAUGGG-3' | (SEQ ID NO: 1518) |
|  | 3'-AGGAGACUUGUGAUAAUAGAAGUACCC-5' | (SEQ ID NO: 750) |
| AT3-1486 Target: | 5'-TCCTCTGAACACTATTATCTTCATGGG-3' | (SEQ ID NO: 1134) |
|  | 5'-CUGAACACUAUUAUCUUCAUGGGCA-3' | (SEQ ID NO: 1519) |
|  | 3'-GAGACUUGUGAUAAUAGAAGUACCCGU-5' | (SEQ ID NO: 751) |
| AT3-1488 Target: | 5'-CTCTGAACACTATTATCTTCATGGGCA-3' | (SEQ ID NO: 1135) |
|  | 5'-CACUAUUAUCUUCAUGGGCAGAGUA-3' | (SEQ ID NO: 1520) |
|  | 3'-UUGUGAUAAUAGAAGUACCCGUCUCAU-5' | (SEQ ID NO: 752) |
| AT3-1493 Target: | 5'-AACACTATTATCTTCATGGGCAGAGTA-3' | (SEQ ID NO: 1136) |
|  | 5'-AGAAGUAAAAAUAAAUACAAACUAC-3' | (SEQ ID NO: 1521) |
|  | 3'-UGUCUUCAUUUUUAUUUAUGUUUGAUG-5' | (SEQ ID NO: 753) |
| AT3-1584 Target: | 5'-ACAGAAGTAAAAATAAATACAAACTAC-3' | (SEQ ID NO: 1137) |
|  | 5'-GAAGUAAAAAUAAAUACAAACUACU-3' | (SEQ ID NO: 1522) |
|  | 3'-GUCUUCAUUUUUAUUUAUGUUUGAUGA-5' | (SEQ ID NO: 754) |
| AT3-1585 Target: | 5'-CAGAAGTAAAAATAAATACAAACTACT-3' | (SEQ ID NO: 1138) |
|  | 5'-GGUGAGAUAUAAGACAUAAUCAGAA-3' | (SEQ ID NO: 1523) |
|  | 3'-CACCACUCUAUAUUCUGUAUUAGUCUU-5' | (SEQ ID NO: 755) |
| AT3-m78 Target: | 5'-GTGGTGAGATATAAGACATAATCAGAA-3' | (SEQ ID NO: 1139) |
|  | 5'-AGCAGCUGAUGGAGGUUUUUAAAUU-3' | (SEQ ID NO: 1524) |
|  | 3'-GUUCGUCGACUACCUCCAAAAAUUUAA-5' | (SEQ ID NO: 756) |
| AT3-m634 Target: | 5'-CAAGCAGCTGATGGAGGTTTTTAAATT-3' | (SEQ ID NO: 1140) |
|  | 5'-AUGGAGGUUUUUAAAUUUGAUACCA-3' | (SEQ ID NO: 1525) |
|  | 3'-ACUACCUCCAAAAAUUUAAACUAUGGU-5' | (SEQ ID NO: 757) |
| AT3-m642 Target: | 5'-TGATGGAGGTTTTTAAATTTGATACCA-3' | (SEQ ID NO: 1141) |
|  | 5'-GGAAGUUGCACUGAACACUAUUAUA-3' | (SEQ ID NO: 1526) |
|  | 3'-UCCCUUCAACGUGACUUGUGAUAAUAU-5' | (SEQ ID NO: 758) |
| AT3-m1574 Target: | 5'-AGGGAAGTTGCACTGAACACTATTATA-3' | (SEQ ID NO: 1142) |
|  | 5'-AGUUGCACUGAACACUAUUAUAUUC-3' | (SEQ ID NO: 1527) |
|  | 3'-CUUCAACGUGACUUGUGAUAAUAUAAG-5' | (SEQ ID NO: 759) |
| AT3-m1577 Target: | 5'-GAAGTTGCACTGAACACTATTATATTC-3' | (SEQ ID NO: 1143) |
|  | 5'-UUGCACUGAACACUAUUAUAUUCAU-3' | (SEQ ID NO: 1528) |
|  | 3'-UCAACGUGACUUGUGAUAAUAUAAGUA-5' | (SEQ ID NO: 760) |
| AT3-m1579 Target: | 5'-AGTTGCACTGAACACTATTATATTCAT-3' | (SEQ ID NO: 1144) |
|  | 5'-CUUUGGUGUUUGUGAAUAGAAGUAA-3' | (SEQ ID NO: 1529) |
|  | 3'-AUGAAACCACAAACACUUAUCUUCAUU-5' | (SEQ ID NO: 761) |
| AT3-m1664 Target: | 5'-TACTTTGGTGTTTGTGAATAGAAGTAA-3' | (SEQ ID NO: 1145) |
|  | 5'-GGUGUUUGUGAAUAGAAGUAAAAAU-3' | (SEQ ID NO: 1530) |
|  | 3'-AACCACAAACACUUAUCUUCAUUUUUA-5' | (SEQ ID NO: 762) |
| AT3-m1668 Target: | 5'-TTGGTGTTTGTGAATAGAAGTAAAAAT-3' | (SEQ ID NO: 1146) |

TABLE 3-continued

Selected Human Anti-AT3 DsiRNAs, Unmodified Duplexes (Asymmetries)

|  |  |  |  |
|---|---|---|---|
|  | 5'-GUGUUUGUGAAUAGAAGUAAAAAUA-3' | (SEQ ID NO: 1531) |  |
|  | 3'-ACCACAAACACUUAUCUUCAUUUUUAU-5' | (SEQ ID NO: 763) |  |
| AT3-m1669 Target: | 5'-TGGTGTTTGTGAATAGAAGTAAAAATA-3' | (SEQ ID NO: 1147) |  |
|  | 5'-UGUUUGUGAAUAGAAGUAAAAAUAA-3' | (SEQ ID NO: 1532) |  |
|  | 3'-CCACAAACACUUAUCUUCAUUUUUAUU-5' | (SEQ ID NO: 764) |  |
| AT3-m1670 Target: | 5'-GGTGTTTGTGAATAGAAGTAAAAATAA-3' | (SEQ ID NO: 1148) |  |
|  | 5'-GUUUGUGAAUAGAAGUAAAAAUAAA-3' | (SEQ ID NO: 1533) |  |
|  | 3'-CACAAACACUUAUCUUCAUUUUUAUUU-5' | (SEQ ID NO: 765) |  |
| AT3-m1671 Target: | 5'-GTGTTTGTGAATAGAAGTAAAAATAAA-3' | (SEQ ID NO: 1149) |  |
|  | 5'-GUGAAUAGAAGUAAAAAUAAAUACG-3' | (SEQ ID NO: 1534) |  |
|  | 3'-AACACUUAUCUUCAUUUUUAUUUAUGC-5' | (SEQ ID NO: 766) |  |
| AT3-m1675 Target: | 5'-TTGTGAATAGAAGTAAAAATAAATACG-3' | (SEQ ID NO: 1150) |  |
|  | 5'-AAGAGGUAAAUAUAUUACUAUUUCA-3' | (SEQ ID NO: 1535) |  |
|  | 3'-UGUUCUCCAUUUAUAUAAUGAUAAAGU-5' | (SEQ ID NO: 767) |  |
| AT3-m1949 Target: | 5'-ACAAGAGGTAAATATATTACTATTTCA-3' | (SEQ ID NO: 1151) |  |
|  | 5'-AGAAAUGCAUUUUUAUACAAAAAAA-3' | (SEQ ID NO: 1536) |  |
|  | 3'-UCUCUUUACGUAAAAAUAUGUUUUUUU-5' | (SEQ ID NO: 768) |  |
| AT3-m2166 Target: | 5'-AGAGAAATGCATTTTTATACAAAAAAA-3' | (SEQ ID NO: 1152) |  |

TABLE 4

DsiRNA Target Sequences (21mers) in AT3 mRNA

| AT3-142 21 nt Target: | 5'-GGCCAUGUAUUCCAAUGUGAU-3' | (SEQ ID NO: 1537) |
|---|---|---|
| AT3-143 21 nt Target: | 5'-GCCAUGUAUUCCAAUGUGAUA-3' | (SEQ ID NO: 1538) |
| AT3-144 21 nt Target: | 5'-CCAUGUAUUCCAAUGUGAUAG-3' | (SEQ ID NO: 1539) |
| AT3-145 21 nt Target: | 5'-CAUGUAUUCCAAUGUGAUAGG-3' | (SEQ ID NO: 1540) |
| AT3-146 21 nt Target: | 5'-AUGUAUUCCAAUGUGAUAGGA-3' | (SEQ ID NO: 1541) |
| AT3-147 21 nt Target: | 5'-UGUAUUCCAAUGUGAUAGGAA-3' | (SEQ ID NO: 1542) |
| AT3-148 21 nt Target: | 5'-GUAUUCCAAUGUGAUAGGAAC-3' | (SEQ ID NO: 1543) |
| AT3-173 21 nt Target: | 5'-ACCUCUGGAAAAAGGAAGGUU-3' | (SEQ ID NO: 1544) |
| AT3-174 21 nt Target: | 5'-CCUCUGGAAAAAGGAAGGUUU-3' | (SEQ ID NO: 1545) |
| AT3-175 21 nt Target: | 5'-CUCUGGAAAAAGGAAGGUUUA-3' | (SEQ ID NO: 1546) |
| AT3-177 21 nt Target: | 5'-CUGGAAAAAGGAAGGUUUAUC-3' | (SEQ ID NO: 1547) |
| AT3-178 21 nt Target: | 5'-UGGAAAAAGGAAGGUUUAUCU-3' | (SEQ ID NO: 1548) |
| AT3-179 21 nt Target: | 5'-GGAAAAAGGAAGGUUUAUCUU-3' | (SEQ ID NO: 1549) |
| AT3-284 21 nt Target: | 5'-AUUCCCAUGAAUCCCAUGUGC-3' | (SEQ ID NO: 1550) |
| AT3-285 21 nt Target: | 5'-UUCCCAUGAAUCCCAUGUGCA-3' | (SEQ ID NO: 1551) |
| AT3-288 21 nt Target: | 5'-CCAUGAAUCCCAUGUGCAUUU-3' | (SEQ ID NO: 1552) |
| AT3-298 21 nt Target: | 5'-CAUGUGCAUUUACCGCUCCCC-3' | (SEQ ID NO: 1553) |
| AT3-381 21 nt Target: | 5'-GUGUCUGGGAACUGUCCAAGG-3' | (SEQ ID NO: 1554) |
| AT3-382 21 nt Target: | 5'-UGUCUGGGAACUGUCCAAGGC-3' | (SEQ ID NO: 1555) |
| AT3-383 21 nt Target: | 5'-GUCUGGGAACUGUCCAAGGCC-3' | (SEQ ID NO: 1556) |
| AT3-384 21 nt Target: | 5'-UCUGGGAACUGUCCAAGGCCA-3' | (SEQ ID NO: 1557) |
| AT3-385 21 nt Target: | 5'-CUGGGAACUGUCCAAGGCCAA-3' | (SEQ ID NO: 1558) |
| AT3-386 21 nt Target: | 5'-UGGGAACUGUCCAAGGCCAAU-3' | (SEQ ID NO: 1559) |

TABLE 4-continued

DsiRNA Target Sequences (21mers) in AT3 mRNA

| | | |
|---|---|---|
| AT3-387 21 nt Target: | 5'-GGGAACUGUCCAAGGCCAAUU-3' | (SEQ ID NO: 1560) |
| AT3-388 21 nt Target: | 5'-GGAACUGUCCAAGGCCAAUUC-3' | (SEQ ID NO: 1561) |
| AT3-403 21 nt Target: | 5'-CAAUUCCCGCUUUGCUACCAC-3' | (SEQ ID NO: 1562) |
| AT3-406 21 nt Target: | 5'-UUCCCGCUUUGCUACCACUUU-3' | (SEQ ID NO: 1563) |
| AT3-407 21 nt Target: | 5'-UCCCGCUUUGCUACCACUUUC-3' | (SEQ ID NO: 1564) |
| AT3-408 21 nt Target: | 5'-CCCGCUUUGCUACCACUUUCU-3' | (SEQ ID NO: 1565) |
| AT3-409 21 nt Target: | 5'-CCGCUUUGCUACCACUUUCUA-3' | (SEQ ID NO: 1566) |
| AT3-410 21 nt Target: | 5'-CGCUUUGCUACCACUUUCUAU-3' | (SEQ ID NO: 1567) |
| AT3-411 21 nt Target: | 5'-GCUUUGCUACCACUUUCUAUC-3' | (SEQ ID NO: 1568) |
| AT3-412 21 nt Target: | 5'-CUUUGCUACCACUUUCUAUCA-3' | (SEQ ID NO: 1569) |
| AT3-413 21 nt Target: | 5'-UUUGCUACCACUUUCUAUCAG-3' | (SEQ ID NO: 1570) |
| AT3-414 21 nt Target: | 5'-UUGCUACCACUUUCUAUCAGC-3' | (SEQ ID NO: 1571) |
| AT3-433 21 nt Target: | 5'-GCACCUGGCAGAUUCCAAGAA-3' | (SEQ ID NO: 1572) |
| AT3-459 21 nt Target: | 5'-AUGAUAACAUUUUCCUGUCAC-3' | (SEQ ID NO: 1573) |
| AT3-462 21 nt Target: | 5'-AUAACAUUUUCCUGUCACCCC-3' | (SEQ ID NO: 1574) |
| AT3-464 21 nt Target: | 5'-AACAUUUUCCUGUCACCCCUG-3' | (SEQ ID NO: 1575) |
| AT3-495 21 nt Target: | 5'-CGGCUUUUGCUAUGACCAAGC-3' | (SEQ ID NO: 1576) |
| AT3-496 21 nt Target: | 5'-GGCUUUUGCUAUGACCAAGCU-3' | (SEQ ID NO: 1577) |
| AT3-497 21 nt Target: | 5'-GCUUUUGCUAUGACCAAGCUG-3' | (SEQ ID NO: 1578) |
| AT3-498 21 nt Target: | 5'-CUUUUGCUAUGACCAAGCUGG-3' | (SEQ ID NO: 1579) |
| AT3-499 21 nt Target: | 5'-UUUUGCUAUGACCAAGCUGGG-3' | (SEQ ID NO: 1580) |
| AT3-500 21 nt Target: | 5'-UUUGCUAUGACCAAGCUGGGU-3' | (SEQ ID NO: 1581) |
| AT3-501 21 nt Target: | 5'-UUGCUAUGACCAAGCUGGGUG-3' | (SEQ ID NO: 1582) |
| AT3-502 21 nt Target: | 5'-UGCUAUGACCAAGCUGGGUGC-3' | (SEQ ID NO: 1583) |
| AT3-503 21 nt Target: | 5'-GCUAUGACCAAGCUGGGUGCC-3' | (SEQ ID NO: 1584) |
| AT3-504 21 nt Target: | 5'-CUAUGACCAAGCUGGGUGCCU-3' | (SEQ ID NO: 1585) |
| AT3-505 21 nt Target: | 5'-UAUGACCAAGCUGGGUGCCUG-3' | (SEQ ID NO: 1586) |
| AT3-506 21 nt Target: | 5'-AUGACCAAGCUGGGUGCCUGU-3' | (SEQ ID NO: 1587) |
| AT3-507 21 nt Target: | 5'-UGACCAAGCUGGGUGCCUGUA-3' | (SEQ ID NO: 1588) |
| AT3-508 21 nt Target: | 5'-GACCAAGCUGGGUGCCUGUAA-3' | (SEQ ID NO: 1589) |
| AT3-538 21 nt Target: | 5'-CCAGCAACUGAUGGAGGUAUU-3' | (SEQ ID NO: 1590) |
| AT3-539 21 nt Target: | 5'-CAGCAACUGAUGGAGGUAUUU-3' | (SEQ ID NO: 1591) |
| AT3-540 21 nt Target: | 5'-AGCAACUGAUGGAGGUAUUUA-3' | (SEQ ID NO: 1592) |
| AT3-541 21 nt Target: | 5'-GCAACUGAUGGAGGUAUUUAA-3' | (SEQ ID NO: 1593) |
| AT3-542 21 nt Target: | 5'-CAACUGAUGGAGGUAUUUAAG-3' | (SEQ ID NO: 1594) |
| AT3-543 21 nt Target: | 5'-AACUGAUGGAGGUAUUUAAGU-3' | (SEQ ID NO: 1595) |
| AT3-544 21 nt Target: | 5'-ACUGAUGGAGGUAUUUAAGUU-3' | (SEQ ID NO: 1596) |
| AT3-545 21 nt Target: | 5'-CUGAUGGAGGUAUUUAAGUUU-3' | (SEQ ID NO: 1597) |
| AT3-546 21 nt Target: | 5'-UGAUGGAGGUAUUUAAGUUUG-3' | (SEQ ID NO: 1598) |

TABLE 4-continued

DsiRNA Target Sequences (21mers) in AT3 mRNA

| | | |
|---|---|---|
| AT3-547 21 nt Target: | 5'-GAUGGAGGUAUUUAAGUUUGA-3' | (SEQ ID NO: 1599) |
| AT3-548 21 nt Target: | 5'-AUGGAGGUAUUUAAGUUUGAC-3' | (SEQ ID NO: 1600) |
| AT3-549 21 nt Target: | 5'-UGGAGGUAUUUAAGUUUGACA-3' | (SEQ ID NO: 1601) |
| AT3-550 21 nt Target: | 5'-GGAGGUAUUUAAGUUUGACAC-3' | (SEQ ID NO: 1602) |
| AT3-551 21 nt Target: | 5'-GAGGUAUUUAAGUUUGACACC-3' | (SEQ ID NO: 1603) |
| AT3-552 21 nt Target: | 5'-AGGUAUUUAAGUUUGACACCA-3' | (SEQ ID NO: 1604) |
| AT3-553 21 nt Target: | 5'-GGUAUUUAAGUUUGACACCAU-3' | (SEQ ID NO: 1605) |
| AT3-554 21 nt Target: | 5'-GUAUUUAAGUUUGACACCAUA-3' | (SEQ ID NO: 1606) |
| AT3-555 21 nt Target: | 5'-UAUUUAAGUUUGACACCAUAU-3' | (SEQ ID NO: 1607) |
| AT3-556 21 nt Target: | 5'-AUUUAAGUUUGACACCAUAUC-3' | (SEQ ID NO: 1608) |
| AT3-557 21 nt Target: | 5'-UUUAAGUUUGACACCAUAUCU-3' | (SEQ ID NO: 1609) |
| AT3-558 21 nt Target: | 5'-UUAAGUUUGACACCAUAUCUG-3' | (SEQ ID NO: 1610) |
| AT3-559 21 nt Target: | 5'-UAAGUUUGACACCAUAUCUGA-3' | (SEQ ID NO: 1611) |
| AT3-560 21 nt Target: | 5'-AAGUUUGACACCAUAUCUGAG-3' | (SEQ ID NO: 1612) |
| AT3-561 21 nt Target: | 5'-AGUUUGACACCAUAUCUGAGA-3' | (SEQ ID NO: 1613) |
| AT3-562 21 nt Target: | 5'-GUUUGACACCAUAUCUGAGAA-3' | (SEQ ID NO: 1614) |
| AT3-563 21 nt Target: | 5'-UUUGACACCAUAUCUGAGAAA-3' | (SEQ ID NO: 1615) |
| AT3-564 21 nt Target: | 5'-UUGACACCAUAUCUGAGAAAA-3' | (SEQ ID NO: 1616) |
| AT3-565 21 nt Target: | 5'-UGACACCAUAUCUGAGAAAAC-3' | (SEQ ID NO: 1617) |
| AT3-566 21 nt Target: | 5'-GACACCAUAUCUGAGAAAACA-3' | (SEQ ID NO: 1618) |
| AT3-567 21 nt Target: | 5'-ACACCAUAUCUGAGAAAACAU-3' | (SEQ ID NO: 1619) |
| AT3-568 21 nt Target: | 5'-CACCAUAUCUGAGAAAACAUC-3' | (SEQ ID NO: 1620) |
| AT3-569 21 nt Target: | 5'-ACCAUAUCUGAGAAAACAUCU-3' | (SEQ ID NO: 1621) |
| AT3-570 21 nt Target: | 5'-CCAUAUCUGAGAAAACAUCUG-3' | (SEQ ID NO: 1622) |
| AT3-571 21 nt Target: | 5'-CAUAUCUGAGAAAACAUCUGA-3' | (SEQ ID NO: 1623) |
| AT3-574 21 nt Target: | 5'-AUCUGAGAAAACAUCUGAUCA-3' | (SEQ ID NO: 1624) |
| AT3-575 21 nt Target: | 5'-UCUGAGAAAACAUCUGAUCAG-3' | (SEQ ID NO: 1625) |
| AT3-576 21 nt Target: | 5'-CUGAGAAAACAUCUGAUCAGA-3' | (SEQ ID NO: 1626) |
| AT3-577 21 nt Target: | 5'-UGAGAAAACAUCUGAUCAGAU-3' | (SEQ ID NO: 1627) |
| AT3-589 21 nt Target: | 5'-UGAUCAGAUCCACUUCUUCUU-3' | (SEQ ID NO: 1628) |
| AT3-591 21 nt Target: | 5'-AUCAGAUCCACUUCUUCUUUG-3' | (SEQ ID NO: 1629) |
| AT3-592 21 nt Target: | 5'-UCAGAUCCACUUCUUCUUUGC-3' | (SEQ ID NO: 1630) |
| AT3-593 21 nt Target: | 5'-CAGAUCCACUUCUUCUUUGCC-3' | (SEQ ID NO: 1631) |
| AT3-594 21 nt Target: | 5'-AGAUCCACUUCUUCUUUGCCA-3' | (SEQ ID NO: 1632) |
| AT3-595 21 nt Target: | 5'-GAUCCACUUCUUCUUUGCCAA-3' | (SEQ ID NO: 1633) |
| AT3-596 21 nt Target: | 5'-AUCCACUUCUUCUUUGCCAAA-3' | (SEQ ID NO: 1634) |
| AT3-597 21 nt Target: | 5'-UCCACUUCUUCUUUGCCAAAC-3' | (SEQ ID NO: 1635) |
| AT3-598 21 nt Target: | 5'-CCACUUCUUCUUUGCCAAACU-3' | (SEQ ID NO: 1636) |
| AT3-599 21 nt Target: | 5'-CACUUCUUCUUUGCCAAACUG-3' | (SEQ ID NO: 1637) |

TABLE 4-continued

DsiRNA Target Sequences (21mers) in AT3 mRNA

| | | |
|---|---|---|
| AT3-600 21 nt Target: | 5'-ACUUCUUCUUUGCCAAACUGA-3' | (SEQ ID NO: 1638) |
| AT3-601 21 nt Target: | 5'-CUUCUUCUUUGCCAAACUGAA-3' | (SEQ ID NO: 1639) |
| AT3-602 21 nt Target: | 5'-UUCUUCUUUGCCAAACUGAAC-3' | (SEQ ID NO: 1640) |
| AT3-603 21 nt Target: | 5'-UCUUCUUUGCCAAACUGAACU-3' | (SEQ ID NO: 1641) |
| AT3-604 21 nt Target: | 5'-CUUCUUUGCCAAACUGAACUG-3' | (SEQ ID NO: 1642) |
| AT3-605 21 nt Target: | 5'-UUCUUUGCCAAACUGAACUGC-3' | (SEQ ID NO: 1643) |
| AT3-606 21 nt Target: | 5'-UCUUUGCCAAACUGAACUGCC-3' | (SEQ ID NO: 1644) |
| AT3-607 21 nt Target: | 5'-CUUUGCCAAACUGAACUGCCG-3' | (SEQ ID NO: 1645) |
| AT3-608 21 nt Target: | 5'-UUUGCCAAACUGAACUGCCGA-3' | (SEQ ID NO: 1646) |
| AT3-609 21 nt Target: | 5'-UUGCCAAACUGAACUGCCGAC-3' | (SEQ ID NO: 1647) |
| AT3-610 21 nt Target: | 5'-UGCCAAACUGAACUGCCGACU-3' | (SEQ ID NO: 1648) |
| AT3-611 21 nt Target: | 5'-GCCAAACUGAACUGCCGACUC-3' | (SEQ ID NO: 1649) |
| AT3-612 21 nt Target: | 5'-CCAAACUGAACUGCCGACUCU-3' | (SEQ ID NO: 1650) |
| AT3-613 21 nt Target: | 5'-CAAACUGAACUGCCGACUCUA-3' | (SEQ ID NO: 1651) |
| AT3-614 21 nt Target: | 5'-AAACUGAACUGCCGACUCUAU-3' | (SEQ ID NO: 1652) |
| AT3-615 21 nt Target: | 5'-AACUGAACUGCCGACUCUAUC-3' | (SEQ ID NO: 1653) |
| AT3-616 21 nt Target: | 5'-ACUGAACUGCCGACUCUAUCG-3' | (SEQ ID NO: 1654) |
| AT3-617 21 nt Target: | 5'-CUGAACUGCCGACUCUAUCGA-3' | (SEQ ID NO: 1655) |
| AT3-618 21 nt Target: | 5'-UGAACUGCCGACUCUAUCGAA-3' | (SEQ ID NO: 1656) |
| AT3-619 21 nt Target: | 5'-GAACUGCCGACUCUAUCGAAA-3' | (SEQ ID NO: 1657) |
| AT3-620 21 nt Target: | 5'-AACUGCCGACUCUAUCGAAAA-3' | (SEQ ID NO: 1658) |
| AT3-621 21 nt Target: | 5'-ACUGCCGACUCUAUCGAAAAG-3' | (SEQ ID NO: 1659) |
| AT3-622 21 nt Target: | 5'-CUGCCGACUCUAUCGAAAAGC-3' | (SEQ ID NO: 1660) |
| AT3-623 21 nt Target: | 5'-UGCCGACUCUAUCGAAAAGCC-3' | (SEQ ID NO: 1661) |
| AT3-624 21 nt Target: | 5'-GCCGACUCUAUCGAAAAGCCA-3' | (SEQ ID NO: 1662) |
| AT3-625 21 nt Target: | 5'-CCGACUCUAUCGAAAAGCCAA-3' | (SEQ ID NO: 1663) |
| AT3-626 21 nt Target: | 5'-CGACUCUAUCGAAAAGCCAAC-3' | (SEQ ID NO: 1664) |
| AT3-627 21 nt Target: | 5'-GACUCUAUCGAAAAGCCAACA-3' | (SEQ ID NO: 1665) |
| AT3-628 21 nt Target: | 5'-ACUCUAUCGAAAAGCCAACAA-3' | (SEQ ID NO: 1666) |
| AT3-635 21 nt Target: | 5'-CGAAAAGCCAACAAAUCCUCC-3' | (SEQ ID NO: 1667) |
| AT3-636 21 nt Target: | 5'-GAAAAGCCAACAAAUCCUCCA-3' | (SEQ ID NO: 1668) |
| AT3-639 21 nt Target: | 5'-AAGCCAACAAAUCCUCCAAGU-3' | (SEQ ID NO: 1669) |
| AT3-640 21 nt Target: | 5'-AGCCAACAAAUCCUCCAAGUU-3' | (SEQ ID NO: 1670) |
| AT3-641 21 nt Target: | 5'-GCCAACAAAUCCUCCAAGUUA-3' | (SEQ ID NO: 1671) |
| AT3-642 21 nt Target: | 5'-CCAACAAAUCCUCCAAGUUAG-3' | (SEQ ID NO: 1672) |
| AT3-643 21 nt Target: | 5'-CAACAAAUCCUCCAAGUUAGU-3' | (SEQ ID NO: 1673) |
| AT3-644 21 nt Target: | 5'-AACAAAUCCUCCAAGUUAGUA-3' | (SEQ ID NO: 1674) |
| AT3-655 21 nt Target: | 5'-CAAGUUAGUAUCAGCCAAUCG-3' | (SEQ ID NO: 1675) |
| AT3-659 21 nt Target: | 5'-UUAGUAUCAGCCAAUCGCCUU-3' | (SEQ ID NO: 1676) |

TABLE 4-continued

DsiRNA Target Sequences (21mers) in AT3 mRNA

| | | |
|---|---|---|
| AT3-664 21 nt Target: | 5'-AUCAGCCAAUCGCCUUUUUGG-3' | (SEQ ID NO: 1677) |
| AT3-665 21 nt Target: | 5'-UCAGCCAAUCGCCUUUUUGGA-3' | (SEQ ID NO: 1678) |
| AT3-666 21 nt Target: | 5'-CAGCCAAUCGCCUUUUUGGAG-3' | (SEQ ID NO: 1679) |
| AT3-670 21 nt Target: | 5'-CAAUCGCCUUUUUGGAGACAA-3' | (SEQ ID NO: 1680) |
| AT3-672 21 nt Target: | 5'-AUCGCCUUUUUGGAGACAAAU-3' | (SEQ ID NO: 1681) |
| AT3-673 21 nt Target: | 5'-UCGCCUUUUUGGAGACAAAUC-3' | (SEQ ID NO: 1682) |
| AT3-674 21 nt Target: | 5'-CGCCUUUUUGGAGACAAAUCC-3' | (SEQ ID NO: 1683) |
| AT3-675 21 nt Target: | 5'-GCCUUUUUGGAGACAAAUCCC-3' | (SEQ ID NO: 1684) |
| AT3-676 21 nt Target: | 5'-CCUUUUUGGAGACAAAUCCCU-3' | (SEQ ID NO: 1685) |
| AT3-680 21 nt Target: | 5'-UUUGGAGACAAAUCCCUUACC-3' | (SEQ ID NO: 1686) |
| AT3-681 21 nt Target: | 5'-UUGGAGACAAAUCCCUUACCU-3' | (SEQ ID NO: 1687) |
| AT3-682 21 nt Target: | 5'-UGGAGACAAAUCCCUUACCUU-3' | (SEQ ID NO: 1688) |
| AT3-683 21 nt Target: | 5'-GGAGACAAAUCCCUUACCUUC-3' | (SEQ ID NO: 1689) |
| AT3-684 21 nt Target: | 5'-GAGACAAAUCCCUUACCUUCA-3' | (SEQ ID NO: 1690) |
| AT3-685 21 nt Target: | 5'-AGACAAAUCCCUUACCUUCAA-3' | (SEQ ID NO: 1691) |
| AT3-687 21 nt Target: | 5'-ACAAAUCCCUUACCUUCAAUG-3' | (SEQ ID NO: 1692) |
| AT3-688 21 nt Target: | 5'-CAAAUCCCUUACCUUCAAUGA-3' | (SEQ ID NO: 1693) |
| AT3-689 21 nt Target: | 5'-AAAUCCCUUACCUUCAAUGAG-3' | (SEQ ID NO: 1694) |
| AT3-696 21 nt Target: | 5'-UUACCUUCAAUGAGACCUACC-3' | (SEQ ID NO: 1695) |
| AT3-700 21 nt Target: | 5'-CUUCAAUGAGACCUACCAGGA-3' | (SEQ ID NO: 1696) |
| AT3-701 21 nt Target: | 5'-UUCAAUGAGACCUACCAGGAC-3' | (SEQ ID NO: 1697) |
| AT3-702 21 nt Target: | 5'-UCAAUGAGACCUACCAGGACA-3' | (SEQ ID NO: 1698) |
| AT3-704 21 nt Target: | 5'-AAUGAGACCUACCAGGACAUC-3' | (SEQ ID NO: 1699) |
| AT3-706 21 nt Target: | 5'-UGAGACCUACCAGGACAUCAG-3' | (SEQ ID NO: 1700) |
| AT3-710 21 nt Target: | 5'-ACCUACCAGGACAUCAGUGAG-3' | (SEQ ID NO: 1701) |
| AT3-711 21 nt Target: | 5'-CCUACCAGGACAUCAGUGAGU-3' | (SEQ ID NO: 1702) |
| AT3-712 21 nt Target: | 5'-CUACCAGGACAUCAGUGAGUU-3' | (SEQ ID NO: 1703) |
| AT3-713 21 nt Target: | 5'-UACCAGGACAUCAGUGAGUUG-3' | (SEQ ID NO: 1704) |
| AT3-714 21 nt Target: | 5'-ACCAGGACAUCAGUGAGUUGG-3' | (SEQ ID NO: 1705) |
| AT3-715 21 nt Target: | 5'-CCAGGACAUCAGUGAGUUGGU-3' | (SEQ ID NO: 1706) |
| AT3-716 21 nt Target: | 5'-CAGGACAUCAGUGAGUUGGUA-3' | (SEQ ID NO: 1707) |
| AT3-717 21 nt Target: | 5'-AGGACAUCAGUGAGUUGGUAU-3' | (SEQ ID NO: 1708) |
| AT3-718 21 nt Target: | 5'-GGACAUCAGUGAGUUGGUAUA-3' | (SEQ ID NO: 1709) |
| AT3-735 21 nt Target: | 5'-UAUAUGGAGCCAAGCUCCAGC-3' | (SEQ ID NO: 1710) |
| AT3-736 21 nt Target: | 5'-AUAUGGAGCCAAGCUCCAGCC-3' | (SEQ ID NO: 1711) |
| AT3-737 21 nt Target: | 5'-UAUGGAGCCAAGCUCCAGCCC-3' | (SEQ ID NO: 1712) |
| AT3-738 21 nt Target: | 5'-AUGGAGCCAAGCUCCAGCCCC-3' | (SEQ ID NO: 1713) |
| AT3-739 21 nt Target: | 5'-UGGAGCCAAGCUCCAGCCCCU-3' | (SEQ ID NO: 1714) |
| AT3-740 21 nt Target: | 5'-GGAGCCAAGCUCCAGCCCCUG-3' | (SEQ ID NO: 1715) |

TABLE 4-continued

DsiRNA Target Sequences (21mers) in AT3 mRNA

| | | |
|---|---|---|
| AT3-741 21 nt Target: | 5'-GAGCCAAGCUCCAGCCCCUGG-3' | (SEQ ID NO: 1716) |
| AT3-742 21 nt Target: | 5'-AGCCAAGCUCCAGCCCCUGGA-3' | (SEQ ID NO: 1717) |
| AT3-743 21 nt Target: | 5'-GCCAAGCUCCAGCCCCUGGAC-3' | (SEQ ID NO: 1718) |
| AT3-744 21 nt Target: | 5'-CCAAGCUCCAGCCCCUGGACU-3' | (SEQ ID NO: 1719) |
| AT3-745 21 nt Target: | 5'-CAAGCUCCAGCCCCUGGACUU-3' | (SEQ ID NO: 1720) |
| AT3-746 21 nt Target: | 5'-AAGCUCCAGCCCCUGGACUUC-3' | (SEQ ID NO: 1721) |
| AT3-747 21 nt Target: | 5'-AGCUCCAGCCCCUGGACUUCA-3' | (SEQ ID NO: 1722) |
| AT3-748 21 nt Target: | 5'-GCUCCAGCCCCUGGACUUCAA-3' | (SEQ ID NO: 1723) |
| AT3-749 21 nt Target: | 5'-CUCCAGCCCCUGGACUUCAAG-3' | (SEQ ID NO: 1724) |
| AT3-750 21 nt Target: | 5'-UCCAGCCCCUGGACUUCAAGG-3' | (SEQ ID NO: 1725) |
| AT3-751 21 nt Target: | 5'-CCAGCCCCUGGACUUCAAGGA-3' | (SEQ ID NO: 1726) |
| AT3-752 21 nt Target: | 5'-CAGCCCCUGGACUUCAAGGAA-3' | (SEQ ID NO: 1727) |
| AT3-757 21 nt Target: | 5'-CCUGGACUUCAAGGAAAAUGC-3' | (SEQ ID NO: 1728) |
| AT3-758 21 nt Target: | 5'-CUGGACUUCAAGGAAAAUGCA-3' | (SEQ ID NO: 1729) |
| AT3-759 21 nt Target: | 5'-UGGACUUCAAGGAAAAUGCAG-3' | (SEQ ID NO: 1730) |
| AT3-760 21 nt Target: | 5'-GGACUUCAAGGAAAAUGCAGA-3' | (SEQ ID NO: 1731) |
| AT3-762 21 nt Target: | 5'-ACUUCAAGGAAAAUGCAGAGC-3' | (SEQ ID NO: 1732) |
| AT3-763 21 nt Target: | 5'-CUUCAAGGAAAAUGCAGAGCA-3' | (SEQ ID NO: 1733) |
| AT3-764 21 nt Target: | 5'-UUCAAGGAAAAUGCAGAGCAA-3' | (SEQ ID NO: 1734) |
| AT3-765 21 nt Target: | 5'-UCAAGGAAAAUGCAGAGCAAU-3' | (SEQ ID NO: 1735) |
| AT3-794 21 nt Target: | 5'-GCCAUCAACAAAUGGGUGUCC-3' | (SEQ ID NO: 1736) |
| AT3-795 21 nt Target: | 5'-CCAUCAACAAAUGGGUGUCCA-3' | (SEQ ID NO: 1737) |
| AT3-800 21 nt Target: | 5'-AACAAAUGGGUGUCCAAUAAG-3' | (SEQ ID NO: 1738) |
| AT3-864 21 nt Target: | 5'-AUGAGCUCACUGUUCUGGUGC-3' | (SEQ ID NO: 1739) |
| AT3-866 21 nt Target: | 5'-GAGCUCACUGUUCUGGUGCUG-3' | (SEQ ID NO: 1740) |
| AT3-867 21 nt Target: | 5'-AGCUCACUGUUCUGGUGCUGG-3' | (SEQ ID NO: 1741) |
| AT3-868 21 nt Target: | 5'-GCUCACUGUUCUGGUGCUGGU-3' | (SEQ ID NO: 1742) |
| AT3-869 21 nt Target: | 5'-CUCACUGUUCUGGUGCUGGUU-3' | (SEQ ID NO: 1743) |
| AT3-870 21 nt Target: | 5'-UCACUGUUCUGGUGCUGGUUA-3' | (SEQ ID NO: 1744) |
| AT3-871 21 nt Target: | 5'-CACUGUUCUGGUGCUGGUUAA-3' | (SEQ ID NO: 1745) |
| AT3-872 21 nt Target: | 5'-ACUGUUCUGGUGCUGGUUAAC-3' | (SEQ ID NO: 1746) |
| AT3-873 21 nt Target: | 5'-CUGUUCUGGUGCUGGUUAACA-3' | (SEQ ID NO: 1747) |
| AT3-874 21 nt Target: | 5'-UGUUCUGGUGCUGGUUAACAC-3' | (SEQ ID NO: 1748) |
| AT3-875 21 nt Target: | 5'-GUUCUGGUGCUGGUUAACACC-3' | (SEQ ID NO: 1749) |
| AT3-876 21 nt Target: | 5'-UUCUGGUGCUGGUUAACACCA-3' | (SEQ ID NO: 1750) |
| AT3-877 21 nt Target: | 5'-UCUGGUGCUGGUUAACACCAU-3' | (SEQ ID NO: 1751) |
| AT3-878 21 nt Target: | 5'-CUGGUGCUGGUUAACACCAUU-3' | (SEQ ID NO: 1752) |
| AT3-879 21 nt Target: | 5'-UGGUGCUGGUUAACACCAUUU-3' | (SEQ ID NO: 1753) |
| AT3-880 21 nt Target: | 5'-GGUGCUGGUUAACACCAUUUA-3' | (SEQ ID NO: 1754) |

TABLE 4-continued

DsiRNA Target Sequences (21mers) in AT3 mRNA

| | | |
|---|---|---|
| AT3-881 21 nt Target: | 5'-GUGCUGGUUAACACCAUUUAC-3' | (SEQ ID NO: 1755) |
| AT3-882 21 nt Target: | 5'-UGCUGGUUAACACCAUUUACU-3' | (SEQ ID NO: 1756) |
| AT3-883 21 nt Target: | 5'-GCUGGUUAACACCAUUUACUU-3' | (SEQ ID NO: 1757) |
| AT3-884 21 nt Target: | 5'-CUGGUUAACACCAUUUACUUC-3' | (SEQ ID NO: 1758) |
| AT3-885 21 nt Target: | 5'-UGGUUAACACCAUUUACUUCA-3' | (SEQ ID NO: 1759) |
| AT3-886 21 nt Target: | 5'-GGUUAACACCAUUUACUUCAA-3' | (SEQ ID NO: 1760) |
| AT3-887 21 nt Target: | 5'-GUUAACACCAUUUACUUCAAG-3' | (SEQ ID NO: 1761) |
| AT3-888 21 nt Target: | 5'-UUAACACCAUUUACUUCAAGG-3' | (SEQ ID NO: 1762) |
| AT3-889 21 nt Target: | 5'-UAACACCAUUUACUUCAAGGG-3' | (SEQ ID NO: 1763) |
| AT3-890 21 nt Target: | 5'-AACACCAUUUACUUCAAGGGC-3' | (SEQ ID NO: 1764) |
| AT3-891 21 nt Target: | 5'-ACACCAUUUACUUCAAGGGCC-3' | (SEQ ID NO: 1765) |
| AT3-892 21 nt Target: | 5'-CACCAUUUACUUCAAGGGCCU-3' | (SEQ ID NO: 1766) |
| AT3-893 21 nt Target: | 5'-ACCAUUUACUUCAAGGGCCUG-3' | (SEQ ID NO: 1767) |
| AT3-894 21 nt Target: | 5'-CCAUUUACUUCAAGGGCCUGU-3' | (SEQ ID NO: 1768) |
| AT3-895 21 nt Target: | 5'-CAUUUACUUCAAGGGCCUGUG-3' | (SEQ ID NO: 1769) |
| AT3-896 21 nt Target: | 5'-AUUUACUUCAAGGGCCUGUGG-3' | (SEQ ID NO: 1770) |
| AT3-897 21 nt Target: | 5'-UUUACUUCAAGGGCCUGUGGA-3' | (SEQ ID NO: 1771) |
| AT3-898 21 nt Target: | 5'-UUACUUCAAGGGCCUGUGGAA-3' | (SEQ ID NO: 1772) |
| AT3-899 21 nt Target: | 5'-UACUUCAAGGGCCUGUGGAAG-3' | (SEQ ID NO: 1773) |
| AT3-900 21 nt Target: | 5'-ACUUCAAGGGCCUGUGGAAGU-3' | (SEQ ID NO: 1774) |
| AT3-901 21 nt Target: | 5'-CUUCAAGGGCCUGUGGAAGUC-3' | (SEQ ID NO: 1775) |
| AT3-902 21 nt Target: | 5'-UUCAAGGGCCUGUGGAAGUCA-3' | (SEQ ID NO: 1776) |
| AT3-903 21 nt Target: | 5'-UCAAGGGCCUGUGGAAGUCAA-3' | (SEQ ID NO: 1777) |
| AT3-904 21 nt Target: | 5'-CAAGGGCCUGUGGAAGUCAAA-3' | (SEQ ID NO: 1778) |
| AT3-905 21 nt Target: | 5'-AAGGGCCUGUGGAAGUCAAAG-3' | (SEQ ID NO: 1779) |
| AT3-906 21 nt Target: | 5'-AGGGCCUGUGGAAGUCAAAGU-3' | (SEQ ID NO: 1780) |
| AT3-907 21 nt Target: | 5'-GGGCCUGUGGAAGUCAAAGUU-3' | (SEQ ID NO: 1781) |
| AT3-908 21 nt Target: | 5'-GGCCUGUGGAAGUCAAAGUUC-3' | (SEQ ID NO: 1782) |
| AT3-909 21 nt Target: | 5'-GCCUGUGGAAGUCAAAGUUCA-3' | (SEQ ID NO: 1783) |
| AT3-910 21 nt Target: | 5'-CCUGUGGAAGUCAAAGUUCAG-3' | (SEQ ID NO: 1784) |
| AT3-911 21 nt Target: | 5'-CUGUGGAAGUCAAAGUUCAGC-3' | (SEQ ID NO: 1785) |
| AT3-912 21 nt Target: | 5'-UGUGGAAGUCAAAGUUCAGCC-3' | (SEQ ID NO: 1786) |
| AT3-913 21 nt Target: | 5'-GUGGAAGUCAAAGUUCAGCCC-3' | (SEQ ID NO: 1787) |
| AT3-914 21 nt Target: | 5'-UGGAAGUCAAAGUUCAGCCCU-3' | (SEQ ID NO: 1788) |
| AT3-915 21 nt Target: | 5'-GGAAGUCAAAGUUCAGCCCUG-3' | (SEQ ID NO: 1789) |
| AT3-916 21 nt Target: | 5'-GAAGUCAAAGUUCAGCCCUGA-3' | (SEQ ID NO: 1790) |
| AT3-959 21 nt Target: | 5'-UACAAGGCUGAUGGAGAGUCG-3' | (SEQ ID NO: 1791) |
| AT3-966 21 nt Target: | 5'-CUGAUGGAGAGUCGUGUUCAG-3' | (SEQ ID NO: 1792) |
| AT3-967 21 nt Target: | 5'-UGAUGGAGAGUCGUGUUCAGC-3' | (SEQ ID NO: 1793) |

TABLE 4-continued

DsiRNA Target Sequences (21mers) in AT3 mRNA

| | | |
|---|---|---|
| AT3-988 21 nt Target: | 5'-AUCUAUGAUGUACCAGGAAGG-3' | (SEQ ID NO: 1794) |
| AT3-989 21 nt Target: | 5'-UCUAUGAUGUACCAGGAAGGC-3' | (SEQ ID NO: 1795) |
| AT3-990 21 nt Target: | 5'-CUAUGAUGUACCAGGAAGGCA-3' | (SEQ ID NO: 1796) |
| AT3-991 21 nt Target: | 5'-UAUGAUGUACCAGGAAGGCAA-3' | (SEQ ID NO: 1797) |
| AT3-993 21 nt Target: | 5'-UGAUGUACCAGGAAGGCAAGU-3' | (SEQ ID NO: 1798) |
| AT3-1040 21 nt Target: | 5'-ACCCAGGUGCUUGAGUUGCCC-3' | (SEQ ID NO: 1799) |
| AT3-1043 21 nt Target: | 5'-CAGGUGCUUGAGUUGCCCUUC-3' | (SEQ ID NO: 1800) |
| AT3-1044 21 nt Target: | 5'-AGGUGCUUGAGUUGCCCUUCA-3' | (SEQ ID NO: 1801) |
| AT3-1045 21 nt Target: | 5'-GGUGCUUGAGUUGCCCUUCAA-3' | (SEQ ID NO: 1802) |
| AT3-1065 21 nt Target: | 5'-AAGGUGAUGACAUCACCAUGG-3' | (SEQ ID NO: 1803) |
| AT3-1066 21 nt Target: | 5'-AGGUGAUGACAUCACCAUGGU-3' | (SEQ ID NO: 1804) |
| AT3-1093 21 nt Target: | 5'-CUUGCCCAAGCCUGAGAAGAG-3' | (SEQ ID NO: 1805) |
| AT3-1094 21 nt Target: | 5'-UUGCCCAAGCCUGAGAAGAGC-3' | (SEQ ID NO: 1806) |
| AT3-1095 21 nt Target: | 5'-UGCCCAAGCCUGAGAAGAGCC-3' | (SEQ ID NO: 1807) |
| AT3-1096 21 nt Target: | 5'-GCCCAAGCCUGAGAAGAGCCU-3' | (SEQ ID NO: 1808) |
| AT3-1097 21 nt Target: | 5'-CCCAAGCCUGAGAAGAGCCUG-3' | (SEQ ID NO: 1809) |
| AT3-1098 21 nt Target: | 5'-CCAAGCCUGAGAAGAGCCUGG-3' | (SEQ ID NO: 1810) |
| AT3-1099 21 nt Target: | 5'-CAAGCCUGAGAAGAGCCUGGC-3' | (SEQ ID NO: 1811) |
| AT3-1100 21 nt Target: | 5'-AAGCCUGAGAAGAGCCUGGCC-3' | (SEQ ID NO: 1812) |
| AT3-1101 21 nt Target: | 5'-AGCCUGAGAAGAGCCUGGCCA-3' | (SEQ ID NO: 1813) |
| AT3-1102 21 nt Target: | 5'-GCCUGAGAAGAGCCUGGCCAA-3' | (SEQ ID NO: 1814) |
| AT3-1103 21 nt Target: | 5'-CCUGAGAAGAGCCUGGCCAAG-3' | (SEQ ID NO: 1815) |
| AT3-1104 21 nt Target: | 5'-CUGAGAAGAGCCUGGCCAAGG-3' | (SEQ ID NO: 1816) |
| AT3-1105 21 nt Target: | 5'-UGAGAAGAGCCUGGCCAAGGU-3' | (SEQ ID NO: 1817) |
| AT3-1188 21 nt Target: | 5'-UGGUGGUCCACAUGCCCCGCU-3' | (SEQ ID NO: 1818) |
| AT3-1189 21 nt Target: | 5'-GGUGGUCCACAUGCCCCGCUU-3' | (SEQ ID NO: 1819) |
| AT3-1190 21 nt Target: | 5'-GUGGUCCACAUGCCCCGCUUC-3' | (SEQ ID NO: 1820) |
| AT3-1191 21 nt Target: | 5'-UGGUCCACAUGCCCCGCUUCC-3' | (SEQ ID NO: 1821) |
| AT3-1192 21 nt Target: | 5'-GGUCCACAUGCCCCGCUUCCG-3' | (SEQ ID NO: 1822) |
| AT3-1193 21 nt Target: | 5'-GUCCACAUGCCCCGCUUCCGC-3' | (SEQ ID NO: 1823) |
| AT3-1194 21 nt Target: | 5'-UCCACAUGCCCCGCUUCCGCA-3' | (SEQ ID NO: 1824) |
| AT3-1227 21 nt Target: | 5'-UCAGUUUGAAGGAGCAGCUGC-3' | (SEQ ID NO: 1825) |
| AT3-1228 21 nt Target: | 5'-CAGUUUGAAGGAGCAGCUGCA-3' | (SEQ ID NO: 1826) |
| AT3-1231 21 nt Target: | 5'-UUUGAAGGAGCAGCUGCAAGA-3' | (SEQ ID NO: 1827) |
| AT3-1232 21 nt Target: | 5'-UUGAAGGAGCAGCUGCAAGAC-3' | (SEQ ID NO: 1828) |
| AT3-1233 21 nt Target: | 5'-UGAAGGAGCAGCUGCAAGACA-3' | (SEQ ID NO: 1829) |
| AT3-1234 21 nt Target: | 5'-GAAGGAGCAGCUGCAAGACAU-3' | (SEQ ID NO: 1830) |
| AT3-1235 21 nt Target: | 5'-AAGGAGCAGCUGCAAGACAUG-3' | (SEQ ID NO: 1831) |
| AT3-1236 21 nt Target: | 5'-AGGAGCAGCUGCAAGACAUGG-3' | (SEQ ID NO: 1832) |

TABLE 4-continued

DsiRNA Target Sequences (21mers) in AT3 mRNA

| | | |
|---|---|---|
| AT3-1237 21 nt Target: | 5'-GGAGCAGCUGCAAGACAUGGG-3' | (SEQ ID NO: 1833) |
| AT3-1238 21 nt Target: | 5'-GAGCAGCUGCAAGACAUGGGC-3' | (SEQ ID NO: 1834) |
| AT3-1239 21 nt Target: | 5'-AGCAGCUGCAAGACAUGGGCC-3' | (SEQ ID NO: 1835) |
| AT3-1240 21 nt Target: | 5'-GCAGCUGCAAGACAUGGGCCU-3' | (SEQ ID NO: 1836) |
| AT3-1258 21 nt Target: | 5'-CCUUGUCGAUCUGUUCAGCCC-3' | (SEQ ID NO: 1837) |
| AT3-1260 21 nt Target: | 5'-UUGUCGAUCUGUUCAGCCCUG-3' | (SEQ ID NO: 1838) |
| AT3-1261 21 nt Target: | 5'-UGUCGAUCUGUUCAGCCCUGA-3' | (SEQ ID NO: 1839) |
| AT3-1263 21 nt Target: | 5'-UCGAUCUGUUCAGCCCUGAAA-3' | (SEQ ID NO: 1840) |
| AT3-1266 21 nt Target: | 5'-AUCUGUUCAGCCCUGAAAAGU-3' | (SEQ ID NO: 1841) |
| AT3-1268 21 nt Target: | 5'-CUGUUCAGCCCUGAAAAGUCC-3' | (SEQ ID NO: 1842) |
| AT3-1280 21 nt Target: | 5'-GAAAAGUCCAAACUCCCAGGU-3' | (SEQ ID NO: 1843) |
| AT3-1281 21 nt Target: | 5'-AAAAGUCCAAACUCCCAGGUA-3' | (SEQ ID NO: 1844) |
| AT3-1283 21 nt Target: | 5'-AAGUCCAAACUCCCAGGUAUU-3' | (SEQ ID NO: 1845) |
| AT3-1285 21 nt Target: | 5'-GUCCAAACUCCCAGGUAUUGU-3' | (SEQ ID NO: 1846) |
| AT3-1286 21 nt Target: | 5'-UCCAAACUCCCAGGUAUUGUU-3' | (SEQ ID NO: 1847) |
| AT3-1287 21 nt Target: | 5'-CCAAACUCCCAGGUAUUGUUG-3' | (SEQ ID NO: 1848) |
| AT3-1288 21 nt Target: | 5'-CAAACUCCCAGGUAUUGUUGC-3' | (SEQ ID NO: 1849) |
| AT3-1344 21 nt Target: | 5'-UCCAUAAGGCAUUUCUUGAGG-3' | (SEQ ID NO: 1850) |
| AT3-1345 21 nt Target: | 5'-CCAUAAGGCAUUUCUUGAGGU-3' | (SEQ ID NO: 1851) |
| AT3-1346 21 nt Target: | 5'-CAUAAGGCAUUUCUUGAGGUA-3' | (SEQ ID NO: 1852) |
| AT3-1347 21 nt Target: | 5'-AUAAGGCAUUUCUUGAGGUAA-3' | (SEQ ID NO: 1853) |
| AT3-1348 21 nt Target: | 5'-UAAGGCAUUUCUUGAGGUAAA-3' | (SEQ ID NO: 1854) |
| AT3-1349 21 nt Target: | 5'-AAGGCAUUUCUUGAGGUAAAU-3' | (SEQ ID NO: 1855) |
| AT3-1350 21 nt Target: | 5'-AGGCAUUUCUUGAGGUAAAUG-3' | (SEQ ID NO: 1856) |
| AT3-1351 21 nt Target: | 5'-GGCAUUUCUUGAGGUAAAUGA-3' | (SEQ ID NO: 1857) |
| AT3-1358 21 nt Target: | 5'-CUUGAGGUAAAUGAAGAAGGC-3' | (SEQ ID NO: 1858) |
| AT3-1359 21 nt Target: | 5'-UUGAGGUAAAUGAAGAAGGCA-3' | (SEQ ID NO: 1859) |
| AT3-1360 21 nt Target: | 5'-UGAGGUAAAUGAAGAAGGCAG-3' | (SEQ ID NO: 1860) |
| AT3-1361 21 nt Target: | 5'-GAGGUAAAUGAAGAAGGCAGU-3' | (SEQ ID NO: 1861) |
| AT3-1362 21 nt Target: | 5'-AGGUAAAUGAAGAAGGCAGUG-3' | (SEQ ID NO: 1862) |
| AT3-1363 21 nt Target: | 5'-GGUAAAUGAAGAAGGCAGUGA-3' | (SEQ ID NO: 1863) |
| AT3-1364 21 nt Target: | 5'-GUAAAUGAAGAAGGCAGUGAA-3' | (SEQ ID NO: 1864) |
| AT3-1369 21 nt Target: | 5'-UGAAGAAGGCAGUGAAGCAGC-3' | (SEQ ID NO: 1865) |
| AT3-1372 21 nt Target: | 5'-AGAAGGCAGUGAAGCAGCUGC-3' | (SEQ ID NO: 1866) |
| AT3-1373 21 nt Target: | 5'-GAAGGCAGUGAAGCAGCUGCA-3' | (SEQ ID NO: 1867) |
| AT3-1381 21 nt Target: | 5'-UGAAGCAGCUGCAAGUACCGC-3' | (SEQ ID NO: 1868) |
| AT3-1452 21 nt Target: | 5'-CCAACAGGCCUUUCCUGGUUU-3' | (SEQ ID NO: 1869) |
| AT3-1453 21 nt Target: | 5'-CAACAGGCCUUUCCUGGUUUU-3' | (SEQ ID NO: 1870) |
| AT3-1454 21 nt Target: | 5'-AACAGGCCUUUCCUGGUUUUU-3' | (SEQ ID NO: 1871) |

TABLE 4-continued

DsiRNA Target Sequences (21mers) in AT3 mRNA

| | | |
|---|---|---|
| AT3-1455 21 nt Target: | 5'-ACAGGCCUUUCCUGGUUUUUA-3' | (SEQ ID NO: 1872) |
| AT3-1456 21 nt Target: | 5'-CAGGCCUUUCCUGGUUUUUAU-3' | (SEQ ID NO: 1873) |
| AT3-1457 21 nt Target: | 5'-AGGCCUUUCCUGGUUUUUAUA-3' | (SEQ ID NO: 1874) |
| AT3-1459 21 nt Target: | 5'-GCCUUUCCUGGUUUUUAUAAG-3' | (SEQ ID NO: 1875) |
| AT3-1460 21 nt Target: | 5'-CCUUUCCUGGUUUUUAUAAGA-3' | (SEQ ID NO: 1876) |
| AT3-1461 21 nt Target: | 5'-CUUUCCUGGUUUUUAUAAGAG-3' | (SEQ ID NO: 1877) |
| AT3-1462 21 nt Target: | 5'-UUUCCUGGUUUUUAUAAGAGA-3' | (SEQ ID NO: 1878) |
| AT3-1463 21 nt Target: | 5'-UUCCUGGUUUUUAUAAGAGAA-3' | (SEQ ID NO: 1879) |
| AT3-1464 21 nt Target: | 5'-UCCUGGUUUUUAUAAGAGAAG-3' | (SEQ ID NO: 1880) |
| AT3-1465 21 nt Target: | 5'-CCUGGUUUUUAUAAGAGAAGU-3' | (SEQ ID NO: 1881) |
| AT3-1466 21 nt Target: | 5'-CUGGUUUUUAUAAGAGAAGUU-3' | (SEQ ID NO: 1882) |
| AT3-1467 21 nt Target: | 5'-UGGUUUUUAUAAGAGAAGUUC-3' | (SEQ ID NO: 1883) |
| AT3-1468 21 nt Target: | 5'-GGUUUUUAUAAGAGAAGUUCC-3' | (SEQ ID NO: 1884) |
| AT3-1469 21 nt Target: | 5'-GUUUUUAUAAGAGAAGUUCCU-3' | (SEQ ID NO: 1885) |
| AT3-1470 21 nt Target: | 5'-UUUUUAUAAGAGAAGUUCCUC-3' | (SEQ ID NO: 1886) |
| AT3-1471 21 nt Target: | 5'-UUUUAUAAGAGAAGUUCCUCU-3' | (SEQ ID NO: 1887) |
| AT3-1472 21 nt Target: | 5'-UUUAUAAGAGAAGUUCCUCUG-3' | (SEQ ID NO: 1888) |
| AT3-1473 21 nt Target: | 5'-UUAUAAGAGAAGUUCCUCUGA-3' | (SEQ ID NO: 1889) |
| AT3-1474 21 nt Target: | 5'-UAUAAGAGAAGUUCCUCUGAA-3' | (SEQ ID NO: 1890) |
| AT3-1475 21 nt Target: | 5'-AUAAGAGAAGUUCCUCUGAAC-3' | (SEQ ID NO: 1891) |
| AT3-1476 21 nt Target: | 5'-UAAGAGAAGUUCCUCUGAACA-3' | (SEQ ID NO: 1892) |
| AT3-1477 21 nt Target: | 5'-AAGAGAAGUUCCUCUGAACAC-3' | (SEQ ID NO: 1893) |
| AT3-1478 21 nt Target: | 5'-AGAGAAGUUCCUCUGAACACU-3' | (SEQ ID NO: 1894) |
| AT3-1479 21 nt Target: | 5'-GAGAAGUUCCUCUGAACACUA-3' | (SEQ ID NO: 1895) |
| AT3-1480 21 nt Target: | 5'-AGAAGUUCCUCUGAACACUAU-3' | (SEQ ID NO: 1896) |
| AT3-1481 21 nt Target: | 5'-GAAGUUCCUCUGAACACUAUU-3' | (SEQ ID NO: 1897) |
| AT3-1482 21 nt Target: | 5'-AAGUUCCUCUGAACACUAUUA-3' | (SEQ ID NO: 1898) |
| AT3-1483 21 nt Target: | 5'-AGUUCCUCUGAACACUAUUAU-3' | (SEQ ID NO: 1899) |
| AT3-1484 21 nt Target: | 5'-GUUCCUCUGAACACUAUUAUC-3' | (SEQ ID NO: 1900) |
| AT3-1485 21 nt Target: | 5'-UUCCUCUGAACACUAUUAUCU-3' | (SEQ ID NO: 1901) |
| AT3-1486 21 nt Target: | 5'-UCCUCUGAACACUAUUAUCUU-3' | (SEQ ID NO: 1902) |
| AT3-1488 21 nt Target: | 5'-CUCUGAACACUAUUAUCUUCA-3' | (SEQ ID NO: 1903) |
| AT3-1493 21 nt Target: | 5'-AACACUAUUAUCUUCAUGGGC-3' | (SEQ ID NO: 1904) |
| AT3-1584 21 nt Target: | 5'-ACAGAAGUAAAAUAAAUACA-3' | (SEQ ID NO: 1905) |
| AT3-1585 21 nt Target: | 5'-CAGAAGUAAAAUAAAUACAA-3' | (SEQ ID NO: 1906) |
| AT3-m78 21 nt Target: | 5'-GUGGUGAGAUAUAAGACAUAA-3' | (SEQ ID NO: 1907) |
| AT3-m634 21 nt Target: | 5'-CAAGCAGCUGAUGGAGGUUUU-3' | (SEQ ID NO: 1908) |
| AT3-m642 21 nt Target: | 5'-UGAUGGAGGUUUUUAAAUUUG-3' | (SEQ ID NO: 1909) |
| AT3-m1574 21 nt Target: | 5'-AGGGAAGUUGCACUGAACACU-3' | (SEQ ID NO: 1910) |

TABLE 4-continued

DsiRNA Target Sequences (21mers) in AT3 mRNA

| | | | |
|---|---|---|---|
| AT3-m1577 21 nt Target: | 5'-GAAGUUGCACUGAACACUAUU-3' | (SEQ ID NO: 1911) |
| AT3-m1579 21 nt Target: | 5'-AGUUGCACUGAACACUAUUAU-3' | (SEQ ID NO: 1912) |
| AT3-m1664 21 nt Target: | 5'-UACUUUGGUGUUUGUGAAUAG-3' | (SEQ ID NO: 1913) |
| AT3-m1668 21 nt Target: | 5'-UUGGUGUUUGUGAAUAGAAGU-3' | (SEQ ID NO: 1914) |
| AT3-m1669 21 nt Target: | 5'-UGGUGUUUGUGAAUAGAAGUA-3' | (SEQ ID NO: 1915) |
| AT3-m1670 21 nt Target: | 5'-GGUGUUUGUGAAUAGAAGUAA-3' | (SEQ ID NO: 1916) |
| AT3-m1671 21 nt Target: | 5'-GUGUUUGUGAAUAGAAGUAAA-3' | (SEQ ID NO: 1917) |
| AT3-m1675 21 nt Target: | 5'-UUGUGAAUAGAAGUAAAAAUA-3' | (SEQ ID NO: 1918) |
| AT3-m1949 21 nt Target: | 5'-ACAAGAGGUAAAUAUAUUACU-3' | (SEQ ID NO: 1919) |
| AT3-m2166 21 nt Target: | 5'-AGAGAAAUGCAUUUUUAUACA-3' | (SEQ ID NO: 1920) |

TABLE 5

Selected Human Anti-AT3 "Blunt/Blunt" DsiRNAs

| | | |
|---|---|---|
| AT3-142 Target: | 5'-GGCCAUGUAUUCCAAUGUGAUAGGAAC-3'<br>3'-CCGGUACAUAAGGUUACACUAUCCUUG-5'<br>5'-GGCCATGTATTCCAATGTGATAGGAAC-3' | (SEQ ID NO: 1921)<br>(SEQ ID NO: 385)<br>(SEQ ID NO: 769) |
| AT3-143 Target: | 5'-GCCAUGUAUUCCAAUGUGAUAGGAACU-3'<br>3'-CGGUACAUAAGGUUACACUAUCCUUGA-5'<br>5'-GCCATGTATTCCAATGTGATAGGAACT-3' | (SEQ ID NO: 1922)<br>(SEQ ID NO: 386)<br>(SEQ ID NO: 770) |
| AT3-144 Target: | 5'-CCAUGUAUUCCAAUGUGAUAGGAACUG-3'<br>3'-GGUACAUAAGGUUACACUAUCCUUGAC-5'<br>5'-CCATGTATTCCAATGTGATAGGAACTG-3' | (SEQ ID NO: 1923)<br>(SEQ ID NO: 387)<br>(SEQ ID NO: 771) |
| AT3-145 Target: | 5'-CAUGUAUUCCAAUGUGAUAGGAACUGU-3'<br>3'-GUACAUAAGGUUACACUAUCCUUGACA-5'<br>5'-CATGTATTCCAATGTGATAGGAACTGT-3' | (SEQ ID NO: 1924)<br>(SEQ ID NO: 388)<br>(SEQ ID NO: 772) |
| AT3-146 Target: | 5'-AUGUAUUCCAAUGUGAUAGGAACUGUA-3'<br>3'-UACAUAAGGUUACACUAUCCUUGACAU-5'<br>5'-ATGTATTCCAATGTGATAGGAACTGTA-3' | (SEQ ID NO: 1925)<br>(SEQ ID NO: 389)<br>(SEQ ID NO: 773) |
| AT3-147 Target: | 5'-UGUAUUCCAAUGUGAUAGGAACUGUAA-3'<br>3'-ACAUAAGGUUACACUAUCCUUGACAUU-5'<br>5'-TGTATTCCAATGTGATAGGAACTGTAA-3' | (SEQ ID NO: 1926)<br>(SEQ ID NO: 390)<br>(SEQ ID NO: 774) |
| AT3-148 Target: | 5'-GUAUUCCAAUGUGAUAGGAACUGUAAC-3'<br>3'-CAUAAGGUUACACUAUCCUUGACAUUG-5'<br>5'-GTATTCCAATGTGATAGGAACTGTAAC-3' | (SEQ ID NO: 1927)<br>(SEQ ID NO: 391)<br>(SEQ ID NO: 775) |
| AT3-173 Target: | 5'-ACCUCUGGAAAAAGGAAGGUUUAUCUU-3'<br>3'-UGGAGACCUUUUUCCUUCCAAAUAGAA-5'<br>5'-ACCTCTGGAAAAAGGAAGGTTTATCTT-3' | (SEQ ID NO: 1928)<br>(SEQ ID NO: 392)<br>(SEQ ID NO: 776) |
| AT3-174 Target: | 5'-CCUCUGGAAAAAGGAAGGUUUAUCUUU-3'<br>3'-GGAGACCUUUUUCCUUCCAAAUAGAAA-5'<br>5'-CCTCTGGAAAAAGGAAGGTTTATCTTT-3' | (SEQ ID NO: 1929)<br>(SEQ ID NO: 393)<br>(SEQ ID NO: 777) |
| AT3-175 Target: | 5'-CUCUGGAAAAAGGAAGGUUUAUCUUUU-3'<br>3'-GAGACCUUUUUCCUUCCAAAUAGAAAA-5'<br>5'-CTCTGGAAAAAGGAAGGTTTATCTTTT-3' | (SEQ ID NO: 1930)<br>(SEQ ID NO: 394)<br>(SEQ ID NO: 778) |
| AT3-177 Target: | 5'-CUGGAAAAAGGAAGGUUUAUCUUUUGU-3'<br>3'-GACCUUUUUCCUUCCAAAUAGAAAACA-5'<br>5'-CTGGAAAAAGGAAGGTTTATCTTTTGT-3' | (SEQ ID NO: 1931)<br>(SEQ ID NO: 395)<br>(SEQ ID NO: 779) |
| AT3-178 Target: | 5'-UGGAAAAAGGAAGGUUUAUCUUUUGUC-3'<br>3'-ACCUUUUUCCUUCCAAAUAGAAAACAG-5'<br>5'-TGGAAAAAGGAAGGTTTATCTTTTGTC-3' | (SEQ ID NO: 1932)<br>(SEQ ID NO: 396)<br>(SEQ ID NO: 780) |
| AT3-179 Target: | 5'-GGAAAAAGGAAGGUUUAUCUUUUGUCC-3'<br>3'-CCUUUUUCCUUCCAAAUAGAAAACAGG-5'<br>5'-GGAAAAAGGAAGGTTTATCTTTTGTCC-3' | (SEQ ID NO: 1933)<br>(SEQ ID NO: 397)<br>(SEQ ID NO: 781) |

TABLE 5-continued

Selected Human Anti-AT3 "Blunt/Blunt" DsiRNAs

```
                5'-AUUCCCAUGAAUCCCAUGUGCAUUUAC-3'     (SEQ ID NO: 1934)
                3'-UAAGGGUACUUAGGGUACACGUAAAUG-5'     (SEQ ID NO: 398)
AT3-284 Target: 5'-ATTCCCATGAATCCCATGTGCATTTAC-3'     (SEQ ID NO: 782)

5'-UUCCCAUGAAUCCCAUGUGCAUUUACC-3'     (SEQ ID NO: 1935)
                3'-AAGGGUACUUAGGGUACACGUAAAUGG-5'     (SEQ ID NO: 399)
AT3-285 Target: 5'-TTCCCATGAATCCCATGTGCATTTACC-3'     (SEQ ID NO: 783)

5'-CCAUGAAUCCCAUGUGCAUUUACCGCU-3'     (SEQ ID NO: 1936)
                3'-GGUACUUAGGGUACACGUAAAUGGCGA-5'     (SEQ ID NO: 400)
AT3-288 Target: 5'-CCATGAATCCCATGTGCATTTACCGCT-3'     (SEQ ID NO: 784)

5'-CAUGUGCAUUUACCGCUCCCCGGAGAA-3'     (SEQ ID NO: 1937)
                3'-GUACACGUAAAUGGCGAGGGGCCUCUU-5'     (SEQ ID NO: 401)
AT3-298 Target: 5'-CATGTGCATTTACCGCTCCCCGGAGAA-3'     (SEQ ID NO: 785)

5'-GUGUCUGGGAACUGUCCAAGGCCAAUU-3'     (SEQ ID NO: 1938)
                3'-CACAGACCCUUGACAGGUUCCGGUUAA-5'     (SEQ ID NO: 402)
AT3-381 Target: 5'-GTGTCTGGGAACTGTCCAAGGCCAATT-3'     (SEQ ID NO: 786)

5'-UGUCUGGGAACUGUCCAAGGCCAAUUC-3'     (SEQ ID NO: 1939)
                3'-ACAGACCCUUGACAGGUUCCGGUUAAG-5'     (SEQ ID NO: 403)
AT3-382 Target: 5'-TGTCTGGGAACTGTCCAAGGCCAATTC-3'     (SEQ ID NO: 787)

5'-GUCUGGGAACUGUCCAAGGCCAAUUCC-3'     (SEQ ID NO: 1940)
                3'-CAGACCCUUGACAGGUUCCGGUUAAGG-5'     (SEQ ID NO: 404)
AT3-383 Target: 5'-GTCTGGGAACTGTCCAAGGCCAATTCC-3'     (SEQ ID NO: 788)

5'-UCUGGGAACUGUCCAAGGCCAAUUCCC-3'     (SEQ ID NO: 1941)
                3'-AGACCCUUGACAGGUUCCGGUUAAGGG-5'     (SEQ ID NO: 405)
AT3-384 Target: 5'-TCTGGGAACTGTCCAAGGCCAATTCCC-3'     (SEQ ID NO: 789)

5'-CUGGGAACUGUCCAAGGCCAAUUCCCG-3'     (SEQ ID NO: 1942)
                3'-GACCCUUGACAGGUUCCGGUUAAGGGC-5'     (SEQ ID NO: 406)
AT3-385 Target: 5'-CTGGGAACTGTCCAAGGCCAATTCCCG-3'     (SEQ ID NO: 790)

5'-UGGGAACUGUCCAAGGCCAAUUCCCGC-3'     (SEQ ID NO: 1943)
                3'-ACCCUUGACAGGUUCCGGUUAAGGGCG-5'     (SEQ ID NO: 407)
AT3-386 Target: 5'-TGGGAACTGTCCAAGGCCAATTCCCGC-3'     (SEQ ID NO: 791)

5'-GGGAACUGUCCAAGGCCAAUUCCCGCU-3'     (SEQ ID NO: 1944)
                3'-CCCUUGACAGGUUCCGGUUAAGGGCGA-5'     (SEQ ID NO: 408)
AT3-387 Target: 5'-GGGAACTGTCCAAGGCCAATTCCCGCT-3'     (SEQ ID NO: 792)

5'-GGAACUGUCCAAGGCCAAUUCCCGCUU-3'     (SEQ ID NO: 1945)
                3'-CCUUGACAGGUUCCGGUUAAGGGCGAA-5'     (SEQ ID NO: 409)
AT3-388 Target: 5'-GGAACTGTCCAAGGCCAATTCCCGCTT-3'     (SEQ ID NO: 793)

5'-CAAUUCCCGCUUUGCUACCACUUUCUA-3'     (SEQ ID NO: 1946)
                3'-GUUAAGGGCGAAACGAUGGUGAAAGAU-5'     (SEQ ID NO: 410)
AT3-403 Target: 5'-CAATTCCCGCTTTGCTACCACTTTCTA-3'     (SEQ ID NO: 794)

5'-UUCCCGCUUUGCUACCACUUUCUAUCA-3'     (SEQ ID NO: 1947)
                3'-AAGGGCGAAACGAUGGUGAAAGAUAGU-5'     (SEQ ID NO: 411)
AT3-406 Target: 5'-TTCCCGCTTTGCTACCACTTTCTATCA-3'     (SEQ ID NO: 795)

5'-UCCCGCUUUGCUACCACUUUCUAUCAG-3'     (SEQ ID NO: 1948)
                3'-AGGGCGAAACGAUGGUGAAAGAUAGUC-5'     (SEQ ID NO: 412)
AT3-407 Target: 5'-TCCCGCTTTGCTACCACTTTCTATCAG-3'     (SEQ ID NO: 796)

5'-CCCGCUUUGCUACCACUUUCUAUCAGC-3'     (SEQ ID NO: 1949)
                3'-GGGCGAAACGAUGGUGAAAGAUAGUCG-5'     (SEQ ID NO: 413)
AT3-408 Target: 5'-CCCGCTTTGCTACCACTTTCTATCAGC-3'     (SEQ ID NO: 797)

5'-CCGCUUUGCUACCACUUUCUAUCAGCA-3'     (SEQ ID NO: 1950)
                3'-GGCGAAACGAUGGUGAAAGAUAGUCGU-5'     (SEQ ID NO: 414)
AT3-409 Target: 5'-CCGCTTTGCTACCACTTTCTATCAGCA-3'     (SEQ ID NO: 798)

5'-CGCUUUGCUACCACUUUCUAUCAGCAC-3'     (SEQ ID NO: 1951)
                3'-GCGAAACGAUGGUGAAAGAUAGUCGUG-5'     (SEQ ID NO: 415)
AT3-410 Target: 5'-CGCTTTGCTACCACTTTCTATCAGCAC-3'     (SEQ ID NO: 799)

5'-GCUUUGCUACCACUUUCUAUCAGCACC-3'     (SEQ ID NO: 1952)
                3'-CGAAACGAUGGUGAAAGAUAGUCGUGG-5'     (SEQ ID NO: 416)
AT3-411 Target: 5'-GCTTTGCTACCACTTTCTATCAGCACC-3'     (SEQ ID NO: 800)
```

TABLE 5-continued

Selected Human Anti-AT3 "Blunt/Blunt" DsiRNAs

|  |  |  |  |
|---|---|---|---|
| AT3-412 | Target: | 5'-CUUUGCUACCACUUUCUAUCAGCACCU-3'<br>3'-GAAACGAUGGUGAAAGAUAGUCGUGGA-5'<br>5'-CTTTGCTACCACTTTCTATCAGCACCT-3' | (SEQ ID NO: 1953)<br>(SEQ ID NO: 417)<br>(SEQ ID NO: 801) |
| AT3-413 | Target: | 5'-UUUGCUACCACUUUCUAUCAGCACCUG-3'<br>3'-AAACGAUGGUGAAAGAUAGUCGUGGAC-5'<br>5'-TTTGCTACCACTTTCTATCAGCACCTG-3' | (SEQ ID NO: 1954)<br>(SEQ ID NO: 418)<br>(SEQ ID NO: 802) |
| AT3-414 | Target: | 5'-UUGCUACCACUUUCUAUCAGCACCUGG-3'<br>3'-AACGAUGGUGAAAGAUAGUCGUGGACC-5'<br>5'-TTGCTACCACTTTCTATCAGCACCTGG-3' | (SEQ ID NO: 1955)<br>(SEQ ID NO: 419)<br>(SEQ ID NO: 803) |
| AT3-433 | Target: | 5'-GCACCUGGCAGAUUCCAAGAAUGACAA-3'<br>3'-CGUGGACCGUCUAAGGUUCUUACUGUU-5'<br>5'-GCACCTGGCAGATTCCAAGAATGACAA-3' | (SEQ ID NO: 1956)<br>(SEQ ID NO: 420)<br>(SEQ ID NO: 804) |
| AT3-459 | Target: | 5'-AUGAUAACAUUUUCCUGUCACCCCUGA-3'<br>3'-UACUAUUGUAAAAGGACAGUGGGGACU-5'<br>5'-ATGATAACATTTTCCTGTCACCCCTGA-3' | (SEQ ID NO: 1957)<br>(SEQ ID NO: 421)<br>(SEQ ID NO: 805) |
| AT3-462 | Target: | 5'-AUAACAUUUUCCUGUCACCCCUGAGUA-3'<br>3'-UAUUGUAAAAGGACAGUGGGGACUCAU-5'<br>5'-ATAACATTTTCCTGTCACCCCTGAGTA-3' | (SEQ ID NO: 1958)<br>(SEQ ID NO: 422)<br>(SEQ ID NO: 806) |
| AT3-464 | Target: | 5'-AACAUUUUCCUGUCACCCCUGAGUAUC-3'<br>3'-UUGUAAAAGGACAGUGGGGACUCAUAG-5'<br>5'-AACATTTTCCTGTCACCCCTGAGTATC-3' | (SEQ ID NO: 1959)<br>(SEQ ID NO: 423)<br>(SEQ ID NO: 807) |
| AT3-495 | Target: | 5'-CGGCUUUUGCUAUGACCAAGCUGGGUG-3'<br>3'-GCCGAAAACGAUACUGGUUCGACCCAC-5'<br>5'-CGGCTTTTGCTATGACCAAGCTGGGTG-3' | (SEQ ID NO: 1960)<br>(SEQ ID NO: 424)<br>(SEQ ID NO: 808) |
| AT3-496 | Target: | 5'-GGCUUUUGCUAUGACCAAGCUGGGUGC-3'<br>3'-CCGAAAACGAUACUGGUUCGACCCACG-5'<br>5'-GGCTTTTGCTATGACCAAGCTGGGTGC-3' | (SEQ ID NO: 1961)<br>(SEQ ID NO: 425)<br>(SEQ ID NO: 809) |
| AT3-497 | Target: | 5'-GCUUUUGCUAUGACCAAGCUGGGUGCC-3'<br>3'-CGAAAACGAUACUGGUUCGACCCACGG-5'<br>5'-GCTTTTGCTATGACCAAGCTGGGTGCC-3' | (SEQ ID NO: 1962)<br>(SEQ ID NO: 426)<br>(SEQ ID NO: 810) |
| AT3-498 | Target: | 5'-CUUUUGCUAUGACCAAGCUGGGUGCCU-3'<br>3'-GAAAACGAUACUGGUUCGACCCACGGA-5'<br>5'-CTTTTGCTATGACCAAGCTGGGTGCCT-3' | (SEQ ID NO: 1963)<br>(SEQ ID NO: 427)<br>(SEQ ID NO: 811) |
| AT3-499 | Target: | 5'-UUUUGCUAUGACCAAGCUGGGUGCCUG-3'<br>3'-AAAACGAUACUGGUUCGACCCACGGAC-5'<br>5'-TTTTGCTATGACCAAGCTGGGTGCCTG-3' | (SEQ ID NO: 1964)<br>(SEQ ID NO: 428)<br>(SEQ ID NO: 812) |
| AT3-500 | Target: | 5'-UUUGCUAUGACCAAGCUGGGUGCCUGU-3'<br>3'-AAACGAUACUGGUUCGACCCACGGACA-5'<br>5'-TTTGCTATGACCAAGCTGGGTGCCTGT-3' | (SEQ ID NO: 1965)<br>(SEQ ID NO: 429)<br>(SEQ ID NO: 813) |
| AT3-501 | Target: | 5'-UUGCUAUGACCAAGCUGGGUGCCUGUA-3'<br>3'-AACGAUACUGGUUCGACCCACGGACAU-5'<br>5'-TTGCTATGACCAAGCTGGGTGCCTGTA-3' | (SEQ ID NO: 1966)<br>(SEQ ID NO: 430)<br>(SEQ ID NO: 814) |
| AT3-502 | Target: | 5'-UGCUAUGACCAAGCUGGGUGCCUGUAA-3'<br>3'-ACGAUACUGGUUCGACCCACGGACAUU-5'<br>5'-TGCTATGACCAAGCTGGGTGCCTGTAA-3' | (SEQ ID NO: 1967)<br>(SEQ ID NO: 431)<br>(SEQ ID NO: 815) |
| AT3-503 | Target: | 5'-GCUAUGACCAAGCUGGGUGCCUGUAAU-3'<br>3'-CGAUACUGGUUCGACCCACGGACAUUA-5'<br>5'-GCTATGACCAAGCTGGGTGCCTGTAAT-3' | (SEQ ID NO: 1968)<br>(SEQ ID NO: 432)<br>(SEQ ID NO: 816) |
| AT3-504 | Target: | 5'-CUAUGACCAAGCUGGGUGCCUGUAAUG-3'<br>3'-GAUACUGGUUCGACCCACGGACAUUAC-5'<br>5'-CTATGACCAAGCTGGGTGCCTGTAATG-3' | (SEQ ID NO: 1969)<br>(SEQ ID NO: 433)<br>(SEQ ID NO: 817) |
| AT3-505 | Target: | 5'-UAUGACCAAGCUGGGUGCCUGUAAUGA-3'<br>3'-AUACUGGUUCGACCCACGGACAUUACU-5'<br>5'-TATGACCAAGCTGGGTGCCTGTAATGA-3' | (SEQ ID NO: 1970)<br>(SEQ ID NO: 434)<br>(SEQ ID NO: 818) |
| AT3-506 | Target: | 5'-AUGACCAAGCUGGGUGCCUGUAAUGAC-3'<br>3'-UACUGGUUCGACCCACGGACAUUACUG-5'<br>5'-ATGACCAAGCTGGGTGCCTGTAATGAC-3' | (SEQ ID NO: 1971)<br>(SEQ ID NO: 435)<br>(SEQ ID NO: 819) |

TABLE 5-continued

Selected Human Anti-AT3 "Blunt/Blunt" DsiRNAs

|  |  |  |
|---|---|---|
| AT3-507 Target: | 5'-UGACCAAGCUGGGUGCCUGUAAUGACA-3'<br>3'-ACUGGUUCGACCCACGGACAUUACUGU-5'<br>5'-TGACCAAGCTGGGTGCCTGTAATGACA-3' | (SEQ ID NO: 1972)<br>(SEQ ID NO: 436)<br>(SEQ ID NO: 820) |
| AT3-508 Target: | 5'-GACCAAGCUGGGUGCCUGUAAUGACAC-3'<br>3'-CUGGUUCGACCCACGGACAUUACUGUG-5'<br>5'-GACCAAGCTGGGTGCCTGTAATGACAC-3' | (SEQ ID NO: 1973)<br>(SEQ ID NO: 437)<br>(SEQ ID NO: 821) |
| AT3-538 Target: | 5'-CCAGCAACUGAUGGAGGUAUUUAAGUU-3'<br>3'-GGUCGUUGACUACCUCCAUAAAUUCAA-5'<br>5'-CCAGCAACTGATGGAGGTATTTAAGTT-3' | (SEQ ID NO: 1974)<br>(SEQ ID NO: 438)<br>(SEQ ID NO: 822) |
| AT3-539 Target: | 5'-CAGCAACUGAUGGAGGUAUUUAAGUUU-3'<br>3'-GUCGUUGACUACCUCCAUAAAUUCAAA-5'<br>5'-CAGCAACTGATGGAGGTATTTAAGTTT-3' | (SEQ ID NO: 1975)<br>(SEQ ID NO: 439)<br>(SEQ ID NO: 823) |
| AT3-540 Target: | 5'-AGCAACUGAUGGAGGUAUUUAAGUUUG-3'<br>3'-UCGUUGACUACCUCCAUAAAUUCAAAC-5'<br>5'-AGCAACTGATGGAGGTATTTAAGTTTG-3' | (SEQ ID NO: 1976)<br>(SEQ ID NO: 440)<br>(SEQ ID NO: 824) |
| AT3-541 Target: | 5'-GCAACUGAUGGAGGUAUUUAAGUUUGA-3'<br>3'-CGUUGACUACCUCCAUAAAUUCAAACU-5'<br>5'-GCAACTGATGGAGGTATTTAAGTTTGA-3' | (SEQ ID NO: 1977)<br>(SEQ ID NO: 441)<br>(SEQ ID NO: 825) |
| AT3-542 Target: | 5'-CAACUGAUGGAGGUAUUUAAGUUUGAC-3'<br>3'-GUUGACUACCUCCAUAAAUUCAAACUG-5'<br>5'-CAACTGATGGAGGTATTTAAGTTTGAC-3' | (SEQ ID NO: 1978)<br>(SEQ ID NO: 442)<br>(SEQ ID NO: 826) |
| AT3-543 Target: | 5'-AACUGAUGGAGGUAUUUAAGUUUGACA-3'<br>3'-UUGACUACCUCCAUAAAUUCAAACUGU-5'<br>5'-AACTGATGGAGGTATTTAAGTTTGACA-3' | (SEQ ID NO: 1979)<br>(SEQ ID NO: 443)<br>(SEQ ID NO: 827) |
| AT3-544 Target: | 5'-ACUGAUGGAGGUAUUUAAGUUUGACAC-3'<br>3'-UGACUACCUCCAUAAAUUCAAACUGUG-5'<br>5'-ACTGATGGAGGTATTTAAGTTTGACAC-3' | (SEQ ID NO: 1980)<br>(SEQ ID NO: 444)<br>(SEQ ID NO: 828) |
| AT3-545 Target: | 5'-CUGAUGGAGGUAUUUAAGUUUGACACC-3'<br>3'-GACUACCUCCAUAAAUUCAAACUGUGG-5'<br>5'-CTGATGGAGGTATTTAAGTTTGACACC-3' | (SEQ ID NO: 1981)<br>(SEQ ID NO: 445)<br>(SEQ ID NO: 829) |
| AT3-546 Target: | 5'-UGAUGGAGGUAUUUAAGUUUGACACCA-3'<br>3'-ACUACCUCCAUAAAUUCAAACUGUGGU-5'<br>5'-TGATGGAGGTATTTAAGTTTGACACCA-3' | (SEQ ID NO: 1982)<br>(SEQ ID NO: 446)<br>(SEQ ID NO: 830) |
| AT3-547 Target: | 5'-GAUGGAGGUAUUUAAGUUUGACACCAU-3'<br>3'-CUACCUCCAUAAAUUCAAACUGUGGUA-5'<br>5'-GATGGAGGTATTTAAGTTTGACACCAT-3' | (SEQ ID NO: 1983)<br>(SEQ ID NO: 447)<br>(SEQ ID NO: 831) |
| AT3-548 Target: | 5'-AUGGAGGUAUUUAAGUUUGACACCAUA-3'<br>3'-UACCUCCAUAAAUUCAAACUGUGGUAU-5'<br>5'-ATGGAGGTATTTAAGTTTGACACCATA-3' | (SEQ ID NO: 1984)<br>(SEQ ID NO: 448)<br>(SEQ ID NO: 832) |
| AT3-549 Target: | 5'-UGGAGGUAUUUAAGUUUGACACCAUAU-3'<br>3'-ACCUCCAUAAAUUCAAACUGUGGUAUA-5'<br>5'-TGGAGGTATTTAAGTTTGACACCATAT-3' | (SEQ ID NO: 1985)<br>(SEQ ID NO: 449)<br>(SEQ ID NO: 833) |
| AT3-550 Target: | 5'-GGAGGUAUUUAAGUUUGACACCAUAUC-3'<br>3'-CCUCCAUAAAUUCAAACUGUGGUAUAG-5'<br>5'-GGAGGTATTTAAGTTTGACACCATATC-3' | (SEQ ID NO: 1986)<br>(SEQ ID NO: 450)<br>(SEQ ID NO: 834) |
| AT3-551 Target: | 5'-GAGGUAUUUAAGUUUGACACCAUAUCU-3'<br>3'-CUCCAUAAAUUCAAACUGUGGUAUAGA-5'<br>5'-GAGGTATTTAAGTTTGACACCATATCT-3' | (SEQ ID NO: 1987)<br>(SEQ ID NO: 451)<br>(SEQ ID NO: 835) |
| AT3-552 Target: | 5'-AGGUAUUUAAGUUUGACACCAUAUCUG-3'<br>3'-UCCAUAAAUUCAAACUGUGGUAUAGAC-5'<br>5'-AGGTATTTAAGTTTGACACCATATCTG-3' | (SEQ ID NO: 1988)<br>(SEQ ID NO: 452)<br>(SEQ ID NO: 836) |
| AT3-553 Target: | 5'-GGUAUUUAAGUUUGACACCAUAUCUGA-3'<br>3'-CCAUAAAUUCAAACUGUGGUAUAGACU-5'<br>5'-GGTATTTAAGTTTGACACCATATCTGA-3' | (SEQ ID NO: 1989)<br>(SEQ ID NO: 453)<br>(SEQ ID NO: 837) |
| AT3-554 Target: | 5'-GUAUUUAAGUUUGACACCAUAUCUGAG-3'<br>3'-CAUAAAUUCAAACUGUGGUAUAGACUC-5'<br>5'-GTATTTAAGTTTGACACCATATCTGAG-3' | (SEQ ID NO: 1990)<br>(SEQ ID NO: 454)<br>(SEQ ID NO: 838) |

TABLE 5-continued

Selected Human Anti-AT3 "Blunt/Blunt" DsiRNAs

|   |   |   |
|---|---|---|
| AT3-555 Target: | 5'-UAUUUAAGUUUGACACCAUAUCUGAGA-3'<br>3'-AUAAAUUCAAACUGUGGUAUAGACUCU-5'<br>5'-TATTTAAGTTTGACACCATATCTGAGA-3' | (SEQ ID NO: 1991)<br>(SEQ ID NO: 455)<br>(SEQ ID NO: 839) |
| AT3-556 Target: | 5'-AUUUAAGUUUGACACCAUAUCUGAGAA-3'<br>3'-UAAAUUCAAACUGUGGUAUAGACUCUU-5'<br>5'-ATTTAAGTTTGACACCATATCTGAGAA-3' | (SEQ ID NO: 1992)<br>(SEQ ID NO: 456)<br>(SEQ ID NO: 840) |
| AT3-557 Target: | 5'-UUUAAGUUUGACACCAUAUCUGAGAAA-3'<br>3'-AAAUUCAAACUGUGGUAUAGACUCUUU-5'<br>5'-TTTAAGTTTGACACCATATCTGAGAAA-3' | (SEQ ID NO: 1993)<br>(SEQ ID NO: 457)<br>(SEQ ID NO: 841) |
| AT3-558 Target: | 5'-UUAAGUUUGACACCAUAUCUGAGAAAA-3'<br>3'-AAUUCAAACUGUGGUAUAGACUCUUUU-5'<br>5'-TTAAGTTTGACACCATATCTGAGAAAA-3' | (SEQ ID NO: 1994)<br>(SEQ ID NO: 458)<br>(SEQ ID NO: 842) |
| AT3-559 Target: | 5'-UAAGUUUGACACCAUAUCUGAGAAAAC-3'<br>3'-AUUCAAACUGUGGUAUAGACUCUUUUG-5'<br>5'-TAAGTTTGACACCATATCTGAGAAAAC-3' | (SEQ ID NO: 1995)<br>(SEQ ID NO: 459)<br>(SEQ ID NO: 843) |
| AT3-560 Target: | 5'-AAGUUUGACACCAUAUCUGAGAAAACA-3'<br>3'-UUCAAACUGUGGUAUAGACUCUUUUGU-5'<br>5'-AAGTTTGACACCATATCTGAGAAAACA-3' | (SEQ ID NO: 1996)<br>(SEQ ID NO: 460)<br>(SEQ ID NO: 844) |
| AT3-561 Target: | 5'-AGUUUGACACCAUAUCUGAGAAAACAU-3'<br>3'-UCAAACUGUGGUAUAGACUCUUUUGUA-5'<br>5'-AGTTTGACACCATATCTGAGAAAACAT-3' | (SEQ ID NO: 1997)<br>(SEQ ID NO: 461)<br>(SEQ ID NO: 845) |
| AT3-562 Target: | 5'-GUUUGACACCAUAUCUGAGAAAACAUC-3'<br>3'-CAAACUGUGGUAUAGACUCUUUUGUAG-5'<br>5'-GTTTGACACCATATCTGAGAAAACATC-3' | (SEQ ID NO: 1998)<br>(SEQ ID NO: 462)<br>(SEQ ID NO: 846) |
| AT3-563 Target: | 5'-UUUGACACCAUAUCUGAGAAAACAUCU-3'<br>3'-AAACUGUGGUAUAGACUCUUUUGUAGA-5'<br>5'-TTTGACACCATATCTGAGAAAACATCT-3' | (SEQ ID NO: 1999)<br>(SEQ ID NO: 463)<br>(SEQ ID NO: 847) |
| AT3-564 Target: | 5'-UUGACACCAUAUCUGAGAAAACAUCUG-3'<br>3'-AACUGUGGUAUAGACUCUUUUGUAGAC-5'<br>5'-TTGACACCATATCTGAGAAAACATCTG-3' | (SEQ ID NO: 2000)<br>(SEQ ID NO: 464)<br>(SEQ ID NO: 848) |
| AT3-565 Target: | 5'-UGACACCAUAUCUGAGAAAACAUCUGA-3'<br>3'-ACUGUGGUAUAGACUCUUUUGUAGACU-5'<br>5'-TGACACCATATCTGAGAAAACATCTGA-3' | (SEQ ID NO: 2001)<br>(SEQ ID NO: 465)<br>(SEQ ID NO: 849) |
| AT3-566 Target: | 5'-GACACCAUAUCUGAGAAAACAUCUGAU-3'<br>3'-CUGUGGUAUAGACUCUUUUGUAGACUA-5'<br>5'-GACACCATATCTGAGAAAACATCTGAT-3' | (SEQ ID NO: 2002)<br>(SEQ ID NO: 466)<br>(SEQ ID NO: 850) |
| AT3-567 Target: | 5'-ACACCAUAUCUGAGAAAACAUCUGAUC-3'<br>3'-UGUGGUAUAGACUCUUUUGUAGACUAG-5'<br>5'-ACACCATATCTGAGAAAACATCTGATC-3' | (SEQ ID NO: 2003)<br>(SEQ ID NO: 467)<br>(SEQ ID NO: 851) |
| AT3-568 Target: | 5'-CACCAUAUCUGAGAAAACAUCUGAUCA-3'<br>3'-GUGGUAUAGACUCUUUUGUAGACUAGU-5'<br>5'-CACCATATCTGAGAAAACATCTGATCA-3' | (SEQ ID NO: 2004)<br>(SEQ ID NO: 468)<br>(SEQ ID NO: 852) |
| AT3-569 Target: | 5'-ACCAUAUCUGAGAAAACAUCUGAUCAG-3'<br>3'-UGGUAUAGACUCUUUUGUAGACUAGUC-5'<br>5'-ACCATATCTGAGAAAACATCTGATCAG-3' | (SEQ ID NO: 2005)<br>(SEQ ID NO: 469)<br>(SEQ ID NO: 853) |
| AT3-570 Target: | 5'-CCAUAUCUGAGAAAACAUCUGAUCAGA-3'<br>3'-GGUAUAGACUCUUUUGUAGACUAGUCU-5'<br>5'-CCATATCTGAGAAAACATCTGATCAGA-3' | (SEQ ID NO: 2006)<br>(SEQ ID NO: 470)<br>(SEQ ID NO: 854) |
| AT3-571 Target: | 5'-CAUAUCUGAGAAAACAUCUGAUCAGAU-3'<br>3'-GUAUAGACUCUUUUGUAGACUAGUCUA-5'<br>5'-CATATCTGAGAAAACATCTGATCAGAT-3' | (SEQ ID NO: 2007)<br>(SEQ ID NO: 471)<br>(SEQ ID NO: 855) |
| AT3-574 Target: | 5'-AUCUGAGAAAACAUCUGAUCAGAUCCA-3'<br>3'-UAGACUCUUUUGUAGACUAGUCUAGGU-5'<br>5'-ATCTGAGAAAACATCTGATCAGATCCA-3' | (SEQ ID NO: 2008)<br>(SEQ ID NO: 472)<br>(SEQ ID NO: 856) |
| AT3-575 Target: | 5'-UCUGAGAAAACAUCUGAUCAGAUCCAC-3'<br>3'-AGACUCUUUUGUAGACUAGUCUAGGUG-5'<br>5'-TCTGAGAAAACATCTGATCAGATCCAC-3' | (SEQ ID NO: 2009)<br>(SEQ ID NO: 473)<br>(SEQ ID NO: 857) |

TABLE 5-continued

Selected Human Anti-AT3 "Blunt/Blunt" DsiRNAs

| | | |
|---|---|---|
| AT3-576 Target: | 5'-CUGAGAAAACAUCUGAUCAGAUCCACU-3'<br>3'-GACUCUUUUGUAGACUAGUCUAGGUGA-5'<br>5'-CTGAGAAAACATCTGATCAGATCCACT-3' | (SEQ ID NO: 2010)<br>(SEQ ID NO: 474)<br>(SEQ ID NO: 858) |
| AT3-577 Target: | 5'-UGAGAAAACAUCUGAUCAGAUCCACUU-3'<br>3'-ACUCUUUUGUAGACUAGUCUAGGUGAA-5'<br>5'-TGAGAAAACATCTGATCAGATCCACTT-3' | (SEQ ID NO: 2011)<br>(SEQ ID NO: 475)<br>(SEQ ID NO: 859) |
| AT3-589 Target: | 5'-UGAUCAGAUCCACUUCUUCUUUGCCAA-3'<br>3'-ACUAGUCUAGGUGAAGAAGAAACGGUU-5'<br>5'-TGATCAGATCCACTTCTTCTTTGCCAA-3' | (SEQ ID NO: 2012)<br>(SEQ ID NO: 476)<br>(SEQ ID NO: 860) |
| AT3-591 Target: | 5'-AUCAGAUCCACUUCUUCUUUGCCAAAC-3'<br>3'-UAGUCUAGGUGAAGAAGAAACGGUUUG-5'<br>5'-ATCAGATCCACTTCTTCTTTGCCAAAC-3' | (SEQ ID NO: 2013)<br>(SEQ ID NO: 477)<br>(SEQ ID NO: 861) |
| AT3-592 Target: | 5'-UCAGAUCCACUUCUUCUUUGCCAAACU-3'<br>3'-AGUCUAGGUGAAGAAGAAACGGUUUGA-5'<br>5'-TCAGATCCACTTCTTCTTTGCCAAACT-3' | (SEQ ID NO: 2014)<br>(SEQ ID NO: 478)<br>(SEQ ID NO: 862) |
| AT3-593 Target: | 5'-CAGAUCCACUUCUUCUUUGCCAAACUG-3'<br>3'-GUCUAGGUGAAGAAGAAACGGUUUGAC-5'<br>5'-CAGATCCACTTCTTCTTTGCCAAACTG-3' | (SEQ ID NO: 2015)<br>(SEQ ID NO: 479)<br>(SEQ ID NO: 863) |
| AT3-594 Target: | 5'-AGAUCCACUUCUUCUUUGCCAAACUGA-3'<br>3'-UCUAGGUGAAGAAGAAACGGUUUGACU-5'<br>5'-AGATCCACTTCTTCTTTGCCAAACTGA-3' | (SEQ ID NO: 2016)<br>(SEQ ID NO: 480)<br>(SEQ ID NO: 864) |
| AT3-595 Target: | 5'-GAUCCACUUCUUCUUUGCCAAACUGAA-3'<br>3'-CUAGGUGAAGAAGAAACGGUUUGACUU-5'<br>5'-GATCCACTTCTTCTTTGCCAAACTGAA-3' | (SEQ ID NO: 2017)<br>(SEQ ID NO: 481)<br>(SEQ ID NO: 865) |
| AT3-596 Target: | 5'-AUCCACUUCUUCUUUGCCAAACUGAAC-3'<br>3'-UAGGUGAAGAAGAAACGGUUUGACUUG-5'<br>5'-ATCCACTTCTTCTTTGCCAAACTGAAC-3' | (SEQ ID NO: 2018)<br>(SEQ ID NO: 482)<br>(SEQ ID NO: 866) |
| AT3-597 Target: | 5'-UCCACUUCUUCUUUGCCAAACUGAACU-3'<br>3'-AGGUGAAGAAGAAACGGUUUGACUUGA-5'<br>5'-TCCACTTCTTCTTTGCCAAACTGAACT-3' | (SEQ ID NO: 2019)<br>(SEQ ID NO: 483)<br>(SEQ ID NO: 867) |
| AT3-598 Target: | 5'-CCACUUCUUCUUUGCCAAACUGAACUG-3'<br>3'-GGUGAAGAAGAAACGGUUUGACUUGAC-5'<br>5'-CCACTTCTTCTTTGCCAAACTGAACTG-3' | (SEQ ID NO: 2020)<br>(SEQ ID NO: 484)<br>(SEQ ID NO: 868) |
| AT3-599 Target: | 5'-CACUUCUUCUUUGCCAAACUGAACUGC-3'<br>3'-GUGAAGAAGAAACGGUUUGACUUGACG-5'<br>5'-CACTTCTTCTTTGCCAAACTGAACTGC-3' | (SEQ ID NO: 2021)<br>(SEQ ID NO: 485)<br>(SEQ ID NO: 869) |
| AT3-600 Target: | 5'-ACUUCUUCUUUGCCAAACUGAACUGCC-3'<br>3'-UGAAGAAGAAACGGUUUGACUUGACGG-5'<br>5'-ACTTCTTCTTTGCCAAACTGAACTGCC-3' | (SEQ ID NO: 2022)<br>(SEQ ID NO: 486)<br>(SEQ ID NO: 870) |
| AT3-601 Target: | 5'-CUUCUUCUUUGCCAAACUGAACUGCCG-3'<br>3'-GAAGAAGAAACGGUUUGACUUGACGGC-5'<br>5'-CTTCTTCTTTGCCAAACTGAACTGCCG-3' | (SEQ ID NO: 2023)<br>(SEQ ID NO: 487)<br>(SEQ ID NO: 871) |
| AT3-602 Target: | 5'-UUCUUCUUUGCCAAACUGAACUGCCGA-3'<br>3'-AAGAAGAAACGGUUUGACUUGACGGCU-5'<br>5'-TTCTTCTTTGCCAAACTGAACTGCCGA-3' | (SEQ ID NO: 2024)<br>(SEQ ID NO: 488)<br>(SEQ ID NO: 872) |
| AT3-603 Target: | 5'-UCUUCUUUGCCAAACUGAACUGCCGAC-3'<br>3'-AGAAGAAACGGUUUGACUUGACGGCUG-5'<br>5'-TCTTCTTTGCCAAACTGAACTGCCGAC-3' | (SEQ ID NO: 2025)<br>(SEQ ID NO: 489)<br>(SEQ ID NO: 873) |
| AT3-604 Target: | 5'-CUUCUUUGCCAAACUGAACUGCCGACU-3'<br>3'-GAAGAAACGGUUUGACUUGACGGCUGA-5'<br>5'-CTTCTTTGCCAAACTGAACTGCCGACT-3' | (SEQ ID NO: 2026)<br>(SEQ ID NO: 490)<br>(SEQ ID NO: 874) |
| AT3-605 Target: | 5'-UUCUUUGCCAAACUGAACUGCCGACUC-3'<br>3'-AAGAAACGGUUUGACUUGACGGCUGAG-5'<br>5'-TTCTTTGCCAAACTGAACTGCCGACTC-3' | (SEQ ID NO: 2027)<br>(SEQ ID NO: 491)<br>(SEQ ID NO: 875) |
| AT3-606 Target: | 5'-UCUUUGCCAAACUGAACUGCCGACUCU-3'<br>3'-AGAAACGGUUUGACUUGACGGCUGAGA-5'<br>5'-TCTTTGCCAAACTGAACTGCCGACTCT-3' | (SEQ ID NO: 2028)<br>(SEQ ID NO: 492)<br>(SEQ ID NO: 876) |

TABLE 5-continued

Selected Human Anti-AT3 "Blunt/Blunt" DsiRNAs

|  |  |  |
|---|---|---|
| AT3-607 Target: | 5'-CUUUGCCAAACUGAACUGCCGACUCUA-3'<br>3'-GAAACGGUUUGACUUGACGGCUGAGAU-5'<br>5'-CTTTGCCAAACTGAACTGCCGACTCTA-3' | (SEQ ID NO: 2029)<br>(SEQ ID NO: 493)<br>(SEQ ID NO: 877) |
| AT3-608 Target: | 5'-UUUGCCAAACUGAACUGCCGACUCUAU-3'<br>3'-AAACGGUUUGACUUGACGGCUGAGAUA-5'<br>5'-TTTGCCAAACTGAACTGCCGACTCTAT-3' | (SEQ ID NO: 2030)<br>(SEQ ID NO: 494)<br>(SEQ ID NO: 878) |
| AT3-609 Target: | 5'-UUGCCAAACUGAACUGCCGACUCUAUC-3'<br>3'-AACGGUUUGACUUGACGGCUGAGAUAG-5'<br>5'-TTGCCAAACTGAACTGCCGACTCTATC-3' | (SEQ ID NO: 2031)<br>(SEQ ID NO: 495)<br>(SEQ ID NO: 879) |
| AT3-610 Target: | 5'-UGCCAAACUGAACUGCCGACUCUAUCG-3'<br>3'-ACGGUUUGACUUGACGGCUGAGAUAGC-5'<br>5'-TGCCAAACTGAACTGCCGACTCTATCG-3' | (SEQ ID NO: 2032)<br>(SEQ ID NO: 496)<br>(SEQ ID NO: 880) |
| AT3-611 Target: | 5'-GCCAAACUGAACUGCCGACUCUAUCGA-3'<br>3'-CGGUUUGACUUGACGGCUGAGAUAGCU-5'<br>5'-GCCAAACTGAACTGCCGACTCTATCGA-3' | (SEQ ID NO: 2033)<br>(SEQ ID NO: 497)<br>(SEQ ID NO: 881) |
| AT3-612 Target: | 5'-CCAAACUGAACUGCCGACUCUAUCGAA-3'<br>3'-GGUUUGACUUGACGGCUGAGAUAGCUU-5'<br>5'-CCAAACTGAACTGCCGACTCTATCGAA-3' | (SEQ ID NO: 2034)<br>(SEQ ID NO: 498)<br>(SEQ ID NO: 882) |
| AT3-613 Target: | 5'-CAAACUGAACUGCCGACUCUAUCGAAA-3'<br>3'-GUUUGACUUGACGGCUGAGAUAGCUUU-5'<br>5'-CAAACTGAACTGCCGACTCTATCGAAA-3' | (SEQ ID NO: 2035)<br>(SEQ ID NO: 499)<br>(SEQ ID NO: 883) |
| AT3-614 Target: | 5'-AAACUGAACUGCCGACUCUAUCGAAAA-3'<br>3'-UUUGACUUGACGGCUGAGAUAGCUUUU-5'<br>5'-AAACTGAACTGCCGACTCTATCGAAAA-3' | (SEQ ID NO: 2036)<br>(SEQ ID NO: 500)<br>(SEQ ID NO: 884) |
| AT3-615 Target: | 5'-AACUGAACUGCCGACUCUAUCGAAAAG-3'<br>3'-UUGACUUGACGGCUGAGAUAGCUUUUC-5'<br>5'-AACTGAACTGCCGACTCTATCGAAAAG-3' | (SEQ ID NO: 2037)<br>(SEQ ID NO: 501)<br>(SEQ ID NO: 885) |
| AT3-616 Target: | 5'-ACUGAACUGCCGACUCUAUCGAAAAGC-3'<br>3'-UGACUUGACGGCUGAGAUAGCUUUUCG-5'<br>5'-ACTGAACTGCCGACTCTATCGAAAAGC-3' | (SEQ ID NO: 2038)<br>(SEQ ID NO: 502)<br>(SEQ ID NO: 886) |
| AT3-617 Target: | 5'-CUGAACUGCCGACUCUAUCGAAAAGCC-3'<br>3'-GACUUGACGGCUGAGAUAGCUUUUCGG-5'<br>5'-CTGAACTGCCGACTCTATCGAAAAGCC-3' | (SEQ ID NO: 2039)<br>(SEQ ID NO: 503)<br>(SEQ ID NO: 887) |
| AT3-618 Target: | 5'-UGAACUGCCGACUCUAUCGAAAAGCCA-3'<br>3'-ACUUGACGGCUGAGAUAGCUUUUCGGU-5'<br>5'-TGAACTGCCGACTCTATCGAAAAGCCA-3' | (SEQ ID NO: 2040)<br>(SEQ ID NO: 504)<br>(SEQ ID NO: 888) |
| AT3-619 Target: | 5'-GAACUGCCGACUCUAUCGAAAAGCCAA-3'<br>3'-CUUGACGGCUGAGAUAGCUUUUCGGUU-5'<br>5'-GAACTGCCGACTCTATCGAAAAGCCAA-3' | (SEQ ID NO: 2041)<br>(SEQ ID NO: 505)<br>(SEQ ID NO: 889) |
| AT3-620 Target: | 5'-AACUGCCGACUCUAUCGAAAAGCCAAC-3'<br>3'-UUGACGGCUGAGAUAGCUUUUCGGUUG-5'<br>5'-AACTGCCGACTCTATCGAAAAGCCAAC-3' | (SEQ ID NO: 2042)<br>(SEQ ID NO: 506)<br>(SEQ ID NO: 890) |
| AT3-621 Target: | 5'-ACUGCCGACUCUAUCGAAAAGCCAACA-3'<br>3'-UGACGGCUGAGAUAGCUUUUCGGUUGU-5'<br>5'-ACTGCCGACTCTATCGAAAAGCCAACA-3' | (SEQ ID NO: 2043)<br>(SEQ ID NO: 507)<br>(SEQ ID NO: 891) |
| AT3-622 Target: | 5'-CUGCCGACUCUAUCGAAAAGCCAACAA-3'<br>3'-GACGGCUGAGAUAGCUUUUCGGUUGUU-5'<br>5'-CTGCCGACTCTATCGAAAAGCCAACAA-3' | (SEQ ID NO: 2044)<br>(SEQ ID NO: 508)<br>(SEQ ID NO: 892) |
| AT3-623 Target: | 5'-UGCCGACUCUAUCGAAAAGCCAACAAA-3'<br>3'-ACGGCUGAGAUAGCUUUUCGGUUGUUU-5'<br>5'-TGCCGACTCTATCGAAAAGCCAACAAA-3' | (SEQ ID NO: 2045)<br>(SEQ ID NO: 509)<br>(SEQ ID NO: 893) |
| AT3-624 Target: | 5'-GCCGACUCUAUCGAAAAGCCAACAAAU-3'<br>3'-CGGCUGAGAUAGCUUUUCGGUUGUUUA-5'<br>5'-GCCGACTCTATCGAAAAGCCAACAAAT-3' | (SEQ ID NO: 2046)<br>(SEQ ID NO: 510)<br>(SEQ ID NO: 894) |
| AT3-625 Target: | 5'-CCGACUCUAUCGAAAAGCCAACAAAUC-3'<br>3'-GGCUGAGAUAGCUUUUCGGUUGUUUAG-5'<br>5'-CCGACTCTATCGAAAAGCCAACAAATC-3' | (SEQ ID NO: 2047)<br>(SEQ ID NO: 511)<br>(SEQ ID NO: 895) |

TABLE 5-continued

Selected Human Anti-AT3 "Blunt/Blunt" DsiRNAs

| | | | |
|---|---|---|---|
| | 5'-CGACUCUAUCGAAAAGCCAACAAAUCC-3' | (SEQ ID NO: 2048) |
| | 3'-GCUGAGAUAGCUUUUCGGUUGUUUAGG-5' | (SEQ ID NO: 512) |
| AT3-626 Target: | 5'-CGACTCTATCGAAAAGCCAACAAATCC-3' | (SEQ ID NO: 896) |

| | 5'-GACUCUAUCGAAAAGCCAACAAAUCCU-3' | (SEQ ID NO: 2049) |
| | 3'-CUGAGAUAGCUUUUCGGUUGUUUAGGA-5' | (SEQ ID NO: 513) |
| AT3-627 Target: | 5'-GACTCTATCGAAAAGCCAACAAATCCT-3' | (SEQ ID NO: 897) |

| | 5'-ACUCUAUCGAAAAGCCAACAAAUCCUC-3' | (SEQ ID NO: 2050) |
| | 3'-UGAGAUAGCUUUUCGGUUGUUUAGGAG-5' | (SEQ ID NO: 514) |
| AT3-628 Target: | 5'-ACTCTATCGAAAAGCCAACAAATCCTC-3' | (SEQ ID NO: 898) |

| | 5'-CGAAAAGCCAACAAAUCCUCCAAGUUA-3' | (SEQ ID NO: 2051) |
| | 3'-GCUUUUCGGUUGUUUAGGAGGUUCAAU-5' | (SEQ ID NO: 515) |
| AT3-635 Target: | 5'-CGAAAAGCCAACAAATCCTCCAAGTTA-3' | (SEQ ID NO: 899) |

| | 5'-GAAAAGCCAACAAAUCCUCCAAGUUAG-3' | (SEQ ID NO: 2052) |
| | 3'-CUUUUCGGUUGUUUAGGAGGUUCAAUC-5' | (SEQ ID NO: 516) |
| AT3-636 Target: | 5'-GAAAAGCCAACAAATCCTCCAAGTTAG-3' | (SEQ ID NO: 900) |

| | 5'-AAGCCAACAAAUCCUCCAAGUUAGUAU-3' | (SEQ ID NO: 2053) |
| | 3'-UUCGGUUGUUUAGGAGGUUCAAUCAUA-5' | (SEQ ID NO: 517) |
| AT3-639 Target: | 5'-AAGCCAACAAATCCTCCAAGTTAGTAT-3' | (SEQ ID NO: 901) |

| | 5'-AGCCAACAAAUCCUCCAAGUUAGUAUC-3' | (SEQ ID NO: 2054) |
| | 3'-UCGGUUGUUUAGGAGGUUCAAUCAUAG-5' | (SEQ ID NO: 518) |
| AT3-640 Target: | 5'-AGCCAACAAATCCTCCAAGTTAGTATC-3' | (SEQ ID NO: 902) |

| | 5'-GCCAACAAAUCCUCCAAGUUAGUAUCA-3' | (SEQ ID NO: 2055) |
| | 3'-CGGUUGUUUAGGAGGUUCAAUCAUAGU-5' | (SEQ ID NO: 519) |
| AT3-641 Target: | 5'-GCCAACAAATCCTCCAAGTTAGTATCA-3' | (SEQ ID NO: 903) |

| | 5'-CCAACAAAUCCUCCAAGUUAGUAUCAG-3' | (SEQ ID NO: 2056) |
| | 3'-GGUUGUUUAGGAGGUUCAAUCAUAGUC-5' | (SEQ ID NO: 520) |
| AT3-642 Target: | 5'-CCAACAAATCCTCCAAGTTAGTATCAG-3' | (SEQ ID NO: 904) |

| | 5'-CAACAAAUCCUCCAAGUUAGUAUCAGC-3' | (SEQ ID NO: 2057) |
| | 3'-GUUGUUUAGGAGGUUCAAUCAUAGUCG-5' | (SEQ ID NO: 521) |
| AT3-643 Target: | 5'-CAACAAATCCTCCAAGTTAGTATCAGC-3' | (SEQ ID NO: 905) |

| | 5'-AACAAAUCCUCCAAGUUAGUAUCAGCC-3' | (SEQ ID NO: 2058) |
| | 3'-UUGUUUAGGAGGUUCAAUCAUAGUCGG-5' | (SEQ ID NO: 522) |
| AT3-644 Target: | 5'-AACAAATCCTCCAAGTTAGTATCAGCC-3' | (SEQ ID NO: 906) |

| | 5'-CAAGUUAGUAUCAGCCAAUCGCCUUUU-3' | (SEQ ID NO: 2059) |
| | 3'-GUUCAAUCAUAGUCGGUUAGCGGAAAA-5' | (SEQ ID NO: 523) |
| AT3-655 Target: | 5'-CAAGTTAGTATCAGCCAATCGCCTTTT-3' | (SEQ ID NO: 907) |

| | 5'-UUAGUAUCAGCCAAUCGCCUUUUUGGA-3' | (SEQ ID NO: 2060) |
| | 3'-AAUCAUAGUCGGUUAGCGGAAAAACCU-5' | (SEQ ID NO: 524) |
| AT3-659 Target: | 5'-TTAGTATCAGCCAATCGCCTTTTTGGA-3' | (SEQ ID NO: 908) |

| | 5'-AUCAGCCAAUCGCCUUUUUGGAGACAA-3' | (SEQ ID NO: 2061) |
| | 3'-UAGUCGGUUAGCGGAAAAACCUCUGUU-5' | (SEQ ID NO: 525) |
| AT3-664 Target: | 5'-ATCAGCCAATCGCCTTTTTGGAGACAA-3' | (SEQ ID NO: 909) |

| | 5'-UCAGCCAAUCGCCUUUUUGGAGACAAA-3' | (SEQ ID NO: 2062) |
| | 3'-AGUCGGUUAGCGGAAAAACCUCUGUUU-5' | (SEQ ID NO: 526) |
| AT3-665 Target: | 5'-TCAGCCAATCGCCTTTTTGGAGACAAA-3' | (SEQ ID NO: 910) |

| | 5'-CAGCCAAUCGCCUUUUUGGAGACAAAU-3' | (SEQ ID NO: 2063) |
| | 3'-GUCGGUUAGCGGAAAAACCUCUGUUUA-5' | (SEQ ID NO: 527) |
| AT3-666 Target: | 5'-CAGCCAATCGCCTTTTTGGAGACAAAT-3' | (SEQ ID NO: 911) |

| | 5'-CAAUCGCCUUUUUGGAGACAAAUCCCU-3' | (SEQ ID NO: 2064) |
| | 3'-GUUAGCGGAAAAACCUCUGUUUAGGGA-5' | (SEQ ID NO: 528) |
| AT3-670 Target: | 5'-CAATCGCCTTTTTGGAGACAAATCCCT-3' | (SEQ ID NO: 912) |

| | 5'-AUCGCCUUUUUGGAGACAAAUCCCUUA-3' | (SEQ ID NO: 2065) |
| | 3'-UAGCGGAAAAACCUCUGUUUAGGGAAU-5' | (SEQ ID NO: 529) |
| AT3-672 Target: | 5'-ATCGCCTTTTTGGAGACAAATCCCTTA-3' | (SEQ ID NO: 913) |

| | 5'-UCGCCUUUUUGGAGACAAAUCCCUUAC-3' | (SEQ ID NO: 2066) |
| | 3'-AGCGGAAAAACCUCUGUUUAGGGAAUG-5' | (SEQ ID NO: 530) |
| AT3-673 Target: | 5'-TCGCCTTTTTGGAGACAAATCCCTTAC-3' | (SEQ ID NO: 914) |

TABLE 5-continued

Selected Human Anti-AT3 "Blunt/Blunt" DsiRNAs

|              |         |                                        |                  |
|--------------|---------|----------------------------------------|------------------|
|              |         | 5'-CGCCUUUUUGGAGACAAAUCCCUUACC-3'      | (SEQ ID NO: 2067) |
|              |         | 3'-GCGGAAAAACCUCUGUUUAGGGAAUGG-5'      | (SEQ ID NO: 531) |
| AT3-674      | Target: | 5'-CGCCTTTTTGGAGACAAATCCCTTACC-3'      | (SEQ ID NO: 915) |
|              |         | 5'-GCCUUUUUGGAGACAAAUCCCUUACCU-3'      | (SEQ ID NO: 2068) |
|              |         | 3'-CGGAAAAACCUCUGUUUAGGGAAUGGA-5'      | (SEQ ID NO: 532) |
| AT3-675      | Target: | 5'-GCCTTTTTGGAGACAAATCCCTTACCT-3'      | (SEQ ID NO: 916) |
|              |         | 5'-CCUUUUUGGAGACAAAUCCCUUACCUU-3'      | (SEQ ID NO: 2069) |
|              |         | 3'-GGAAAAACCUCUGUUUAGGGAAUGGAA-5'      | (SEQ ID NO: 533) |
| AT3-676      | Target: | 5'-CCTTTTTGGAGACAAATCCCTTACCTT-3'      | (SEQ ID NO: 917) |
|              |         | 5'-UUUGGAGACAAAUCCCUUACCUUCAAU-3'      | (SEQ ID NO: 2070) |
|              |         | 3'-AAACCUCUGUUUAGGGAAUGGAAGUUA-5'      | (SEQ ID NO: 534) |
| AT3-680      | Target: | 5'-TTTGGAGACAAATCCCTTACCTTCAAT-3'      | (SEQ ID NO: 918) |
|              |         | 5'-UUGGAGACAAAUCCCUUACCUUCAAUG-3'      | (SEQ ID NO: 2071) |
|              |         | 3'-AACCUCUGUUUAGGGAAUGGAAGUUAC-5'      | (SEQ ID NO: 535) |
| AT3-681      | Target: | 5'-TTGGAGACAAATCCCTTACCTTCAATG-3'      | (SEQ ID NO: 919) |
|              |         | 5'-UGGAGACAAAUCCCUUACCUUCAAUGA-3'      | (SEQ ID NO: 2072) |
|              |         | 3'-ACCUCUGUUUAGGGAAUGGAAGUUACU-5'      | (SEQ ID NO: 536) |
| AT3-682      | Target: | 5'-TGGAGACAAATCCCTTACCTTCAATGA-3'      | (SEQ ID NO: 920) |
|              |         | 5'-GGAGACAAAUCCCUUACCUUCAAUGAG-3'      | (SEQ ID NO: 2073) |
|              |         | 3'-CCUCUGUUUAGGGAAUGGAAGUUACUC-5'      | (SEQ ID NO: 537) |
| AT3-683      | Target: | 5'-GGAGACAAATCCCTTACCTTCAATGAG-3'      | (SEQ ID NO: 921) |
|              |         | 5'-GAGACAAAUCCCUUACCUUCAAUGAGA-3'      | (SEQ ID NO: 2074) |
|              |         | 3'-CUCUGUUUAGGGAAUGGAAGUUACUCU-5'      | (SEQ ID NO: 538) |
| AT3-684      | Target: | 5'-GAGACAAATCCCTTACCTTCAATGAGA-3'      | (SEQ ID NO: 922) |
|              |         | 5'-AGACAAAUCCCUUACCUUCAAUGAGAC-3'      | (SEQ ID NO: 2075) |
|              |         | 3'-UCUGUUUAGGGAAUGGAAGUUACUCUG-5'      | (SEQ ID NO: 539) |
| AT3-685      | Target: | 5'-AGACAAATCCCTTACCTTCAATGAGAC-3'      | (SEQ ID NO: 923) |
|              |         | 5'-ACAAAUCCCUUACCUUCAAUGAGACCU-3'      | (SEQ ID NO: 2076) |
|              |         | 3'-UGUUUAGGGAAUGGAAGUUACUCUGGA-5'      | (SEQ ID NO: 540) |
| AT3-687      | Target: | 5'-ACAAATCCCTTACCTTCAATGAGACCT-3'      | (SEQ ID NO: 924) |
|              |         | 5'-CAAAUCCCUUACCUUCAAUGAGACCUA-3'      | (SEQ ID NO: 2077) |
|              |         | 3'-GUUUAGGGAAUGGAAGUUACUCUGGAU-5'      | (SEQ ID NO: 541) |
| AT3-688      | Target: | 5'-CAAATCCCTTACCTTCAATGAGACCTA-3'      | (SEQ ID NO: 925) |
|              |         | 5'-AAAUCCCUUACCUUCAAUGAGACCUAC-3'      | (SEQ ID NO: 2078) |
|              |         | 3'-UUUAGGGAAUGGAAGUUACUCUGGAUG-5'      | (SEQ ID NO: 542) |
| AT3-689      | Target: | 5'-AAATCCCTTACCTTCAATGAGACCTAC-3'      | (SEQ ID NO: 926) |
|              |         | 5'-UUACCUUCAAUGAGACCUACCAGGACA-3'      | (SEQ ID NO: 2079) |
|              |         | 3'-AAUGGAAGUUACUCUGGAUGGUCCUGU-5'      | (SEQ ID NO: 543) |
| AT3-696      | Target: | 5'-TTACCTTCAATGAGACCTACCAGGACA-3'      | (SEQ ID NO: 927) |
|              |         | 5'-CUUCAAUGAGACCUACCAGGACAUCAG-3'      | (SEQ ID NO: 2080) |
|              |         | 3'-GAAGUUACUCUGGAUGGUCCUGUAGUC-5'      | (SEQ ID NO: 544) |
| AT3-700      | Target: | 5'-CTTCAATGAGACCTACCAGGACATCAG-3'      | (SEQ ID NO: 928) |
|              |         | 5'-UUCAAUGAGACCUACCAGGACAUCAGU-3'      | (SEQ ID NO: 2081) |
|              |         | 3'-AAGUUACUCUGGAUGGUCCUGUAGUCA-5'      | (SEQ ID NO: 545) |
| AT3-701      | Target: | 5'-TTCAATGAGACCTACCAGGACATCAGT-3'      | (SEQ ID NO: 929) |
|              |         | 5'-UCAAUGAGACCUACCAGGACAUCAGUG-3'      | (SEQ ID NO: 2082) |
|              |         | 3'-AGUUACUCUGGAUGGUCCUGUAGUCAC-5'      | (SEQ ID NO: 546) |
| AT3-702      | Target: | 5'-TCAATGAGACCTACCAGGACATCAGTG-3'      | (SEQ ID NO: 930) |
|              |         | 5'-AAUGAGACCUACCAGGACAUCAGUGAG-3'      | (SEQ ID NO: 2083) |
|              |         | 3'-UUACUCUGGAUGGUCCUGUAGUCACUC-5'      | (SEQ ID NO: 547) |
| AT3-704      | Target: | 5'-AATGAGACCTACCAGGACATCAGTGAG-3'      | (SEQ ID NO: 931) |
|              |         | 5'-UGAGACCUACCAGGACAUCAGUGAGUU-3'      | (SEQ ID NO: 2084) |
|              |         | 3'-ACUCUGGAUGGUCCUGUAGUCACUCAA-5'      | (SEQ ID NO: 548) |
| AT3-706      | Target: | 5'-TGAGACCTACCAGGACATCAGTGAGTT-3'      | (SEQ ID NO: 932) |
|              |         | 5'-ACCUACCAGGACAUCAGUGAGUUGGUA-3'      | (SEQ ID NO: 2085) |
|              |         | 3'-UGGAUGGUCCUGUAGUCACUCAACCAU-5'      | (SEQ ID NO: 549) |
| AT3-710      | Target: | 5'-ACCTACCAGGACATCAGTGAGTTGGTA-3'      | (SEQ ID NO: 933) |

TABLE 5-continued

Selected Human Anti-AT3 "Blunt/Blunt" DsiRNAs

```
                5'-CCUACCAGGACAUCAGUGAGUUGGUAU-3'    (SEQ ID NO: 2086)
                3'-GGAUGGUCCUGUAGUCACUCAACCAUA-5'    (SEQ ID NO: 550)
AT3-711 Target: 5'-CCTACCAGGACATCAGTGAGTTGGTAT-3'    (SEQ ID NO: 934)

5'-CUACCAGGACAUCAGUGAGUUGGUAUA-3'    (SEQ ID NO: 2087)
                3'-GAUGGUCCUGUAGUCACUCAACCAUAU-5'    (SEQ ID NO: 551)
AT3-712 Target: 5'-CTACCAGGACATCAGTGAGTTGGTATA-3'    (SEQ ID NO: 935)

5'-UACCAGGACAUCAGUGAGUUGGUAUAU-3'    (SEQ ID NO: 2088)
                3'-AUGGUCCUGUAGUCACUCAACCAUAUA-5'    (SEQ ID NO: 552)
AT3-713 Target: 5'-TACCAGGACATCAGTGAGTTGGTATAT-3'    (SEQ ID NO: 936)

5'-ACCAGGACAUCAGUGAGUUGGUAUAUG-3'    (SEQ ID NO: 2089)
                3'-UGGUCCUGUAGUCACUCAACCAUAUAC-5'    (SEQ ID NO: 553)
AT3-714 Target: 5'-ACCAGGACATCAGTGAGTTGGTATATG-3'    (SEQ ID NO: 937)

5'-CCAGGACAUCAGUGAGUUGGUAUAUGG-3'    (SEQ ID NO: 2090)
                3'-GGUCCUGUAGUCACUCAACCAUAUACC-5'    (SEQ ID NO: 554)
AT3-715 Target: 5'-CCAGGACATCAGTGAGTTGGTATATGG-3'    (SEQ ID NO: 938)

5'-CAGGACAUCAGUGAGUUGGUAUAUGGA-3'    (SEQ ID NO: 2091)
                3'-GUCCUGUAGUCACUCAACCAUAUACCU-5'    (SEQ ID NO: 555)
AT3-716 Target: 5'-CAGGACATCAGTGAGTTGGTATATGGA-3'    (SEQ ID NO: 939)

5'-AGGACAUCAGUGAGUUGGUAUAUGGAG-3'    (SEQ ID NO: 2092)
                3'-UCCUGUAGUCACUCAACCAUAUACCUC-5'    (SEQ ID NO: 556)
AT3-717 Target: 5'-AGGACATCAGTGAGTTGGTATATGGAG-3'    (SEQ ID NO: 940)

5'-GGACAUCAGUGAGUUGGUAUAUGGAGC-3'    (SEQ ID NO: 2093)
                3'-CCUGUAGUCACUCAACCAUAUACCUCG-5'    (SEQ ID NO: 557)
AT3-718 Target: 5'-GGACATCAGTGAGTTGGTATATGGAGC-3'    (SEQ ID NO: 941)

5'-UAUAUGGAGCCAAGCUCCAGCCCCUGG-3'    (SEQ ID NO: 2094)
                3'-AUAUACCUCGGUUCGAGGUCGGGGACC-5'    (SEQ ID NO: 558)
AT3-735 Target: 5'-TATATGGAGCCAAGCTCCAGCCCCTGG-3'    (SEQ ID NO: 942)

5'-AUAUGGAGCCAAGCUCCAGCCCCUGGA-3'    (SEQ ID NO: 2095)
                3'-UAUACCUCGGUUCGAGGUCGGGGACCU-5'    (SEQ ID NO: 559)
AT3-736 Target: 5'-ATATGGAGCCAAGCTCCAGCCCCTGGA-3'    (SEQ ID NO: 943)

5'-UAUGGAGCCAAGCUCCAGCCCCUGGAC-3'    (SEQ ID NO: 2096)
                3'-AUACCUCGGUUCGAGGUCGGGGACCUG-5'    (SEQ ID NO: 560)
AT3-737 Target: 5'-TATGGAGCCAAGCTCCAGCCCCTGGAC-3'    (SEQ ID NO: 944)

5'-AUGGAGCCAAGCUCCAGCCCCUGGACU-3'    (SEQ ID NO: 2097)
                3'-UACCUCGGUUCGAGGUCGGGGACCUGA-5'    (SEQ ID NO: 561)
AT3-738 Target: 5'-ATGGAGCCAAGCTCCAGCCCCTGGACT-3'    (SEQ ID NO: 945)

5'-UGGAGCCAAGCUCCAGCCCCUGGACUU-3'    (SEQ ID NO: 2098)
                3'-ACCUCGGUUCGAGGUCGGGGACCUGAA-5'    (SEQ ID NO: 562)
AT3-739 Target: 5'-TGGAGCCAAGCTCCAGCCCCTGGACTT-3'    (SEQ ID NO: 946)

5'-GGAGCCAAGCUCCAGCCCCUGGACUUC-3'    (SEQ ID NO: 2099)
                3'-CCUCGGUUCGAGGUCGGGGACCUGAAG-5'    (SEQ ID NO: 563)
AT3-740 Target: 5'-GGAGCCAAGCTCCAGCCCCTGGACTTC-3'    (SEQ ID NO: 947)

5'-GAGCCAAGCUCCAGCCCCUGGACUUCA-3'    (SEQ ID NO: 2100)
                3'-CUCGGUUCGAGGUCGGGGACCUGAAGU-5'    (SEQ ID NO: 564)
AT3-741 Target: 5'-GAGCCAAGCTCCAGCCCCTGGACTTCA-3'    (SEQ ID NO: 948)

5'-AGCCAAGCUCCAGCCCCUGGACUUCAA-3'    (SEQ ID NO: 2101)
                3'-UCGGUUCGAGGUCGGGGACCUGAAGUU-5'    (SEQ ID NO: 565)
AT3-742 Target: 5'-AGCCAAGCTCCAGCCCCTGGACTTCAA-3'    (SEQ ID NO: 949)

5'-GCCAAGCUCCAGCCCCUGGACUUCAAG-3'    (SEQ ID NO: 2102)
                3'-CGGUUCGAGGUCGGGGACCUGAAGUUC-5'    (SEQ ID NO: 566)
AT3-743 Target: 5'-GCCAAGCTCCAGCCCCTGGACTTCAAG-3'    (SEQ ID NO: 950)

5'-CCAAGCUCCAGCCCCUGGACUUCAAGG-3'    (SEQ ID NO: 2103)
                3'-GGUUCGAGGUCGGGGACCUGAAGUUCC-5'    (SEQ ID NO: 567)
AT3-744 Target: 5'-CCAAGCTCCAGCCCCTGGACTTCAAGG-3'    (SEQ ID NO: 951)

5'-CAAGCUCCAGCCCCUGGACUUCAAGGA-3'    (SEQ ID NO: 2104)
                3'-GUUCGAGGUCGGGGACCUGAAGUUCCU-5'    (SEQ ID NO: 568)
AT3-745 Target: 5'-CAAGCTCCAGCCCCTGGACTTCAAGGA-3'    (SEQ ID NO: 952)
```

TABLE 5-continued

Selected Human Anti-AT3 "Blunt/Blunt" DsiRNAs

|  |  |  |  |
|---|---|---|---|
| AT3-746 | Target: | 5'-AAGCUCCAGCCCCUGGACUUCAAGGAA-3'<br>3'-UUCGAGGUCGGGGACCUGAAGUUCCUU-5'<br>5'-AAGCTCCAGCCCCTGGACTTCAAGGAA-3' | (SEQ ID NO: 2105)<br>(SEQ ID NO: 569)<br>(SEQ ID NO: 953) |
| AT3-747 | Target: | 5'-AGCUCCAGCCCCUGGACUUCAAGGAAA-3'<br>3'-UCGAGGUCGGGGACCUGAAGUUCCUUU-5'<br>5'-AGCTCCAGCCCCTGGACTTCAAGGAAA-3' | (SEQ ID NO: 2106)<br>(SEQ ID NO: 570)<br>(SEQ ID NO: 954) |
| AT3-748 | Target: | 5'-GCUCCAGCCCCUGGACUUCAAGGAAAA-3'<br>3'-CGAGGUCGGGGACCUGAAGUUCCUUUU-5'<br>5'-GCTCCAGCCCCTGGACTTCAAGGAAAA-3' | (SEQ ID NO: 2107)<br>(SEQ ID NO: 571)<br>(SEQ ID NO: 955) |
| AT3-749 | Target: | 5'-CUCCAGCCCCUGGACUUCAAGGAAAAU-3'<br>3'-GAGGUCGGGGACCUGAAGUUCCUUUUA-5'<br>5'-CTCCAGCCCCTGGACTTCAAGGAAAAT-3' | (SEQ ID NO: 2108)<br>(SEQ ID NO: 572)<br>(SEQ ID NO: 956) |
| AT3-750 | Target: | 5'-UCCAGCCCCUGGACUUCAAGGAAAAUG-3'<br>3'-AGGUCGGGGACCUGAAGUUCCUUUUAC-5'<br>5'-TCCAGCCCCTGGACTTCAAGGAAAATG-3' | (SEQ ID NO: 2109)<br>(SEQ ID NO: 573)<br>(SEQ ID NO: 957) |
| AT3-751 | Target: | 5'-CCAGCCCCUGGACUUCAAGGAAAAUGC-3'<br>3'-GGUCGGGGACCUGAAGUUCCUUUUACG-5'<br>5'-CCAGCCCCTGGACTTCAAGGAAAATGC-3' | (SEQ ID NO: 2110)<br>(SEQ ID NO: 574)<br>(SEQ ID NO: 958) |
| AT3-752 | Target: | 5'-CAGCCCCUGGACUUCAAGGAAAAUGCA-3'<br>3'-GUCGGGGACCUGAAGUUCCUUUUACGU-5'<br>5'-CAGCCCCTGGACTTCAAGGAAAATGCA-3' | (SEQ ID NO: 2111)<br>(SEQ ID NO: 575)<br>(SEQ ID NO: 959) |
| AT3-757 | Target: | 5'-CCUGGACUUCAAGGAAAAUGCAGAGCA-3'<br>3'-GGACCUGAAGUUCCUUUUACGUCUCGU-5'<br>5'-CCTGGACTTCAAGGAAAATGCAGAGCA-3' | (SEQ ID NO: 2112)<br>(SEQ ID NO: 576)<br>(SEQ ID NO: 960) |
| AT3-758 | Target: | 5'-CUGGACUUCAAGGAAAAUGCAGAGCAA-3'<br>3'-GACCUGAAGUUCCUUUUACGUCUCGUU-5'<br>5'-CTGGACTTCAAGGAAAATGCAGAGCAA-3' | (SEQ ID NO: 2113)<br>(SEQ ID NO: 577)<br>(SEQ ID NO: 961) |
| AT3-759 | Target: | 5'-UGGACUUCAAGGAAAAUGCAGAGCAAU-3'<br>3'-ACCUGAAGUUCCUUUUACGUCUCGUUA-5'<br>5'-TGGACTTCAAGGAAAATGCAGAGCAAT-3' | (SEQ ID NO: 2114)<br>(SEQ ID NO: 578)<br>(SEQ ID NO: 962) |
| AT3-760 | Target: | 5'-GGACUUCAAGGAAAAUGCAGAGCAAUC-3'<br>3'-CCUGAAGUUCCUUUUACGUCUCGUUAG-5'<br>5'-GGACTTCAAGGAAAATGCAGAGCAATC-3' | (SEQ ID NO: 2115)<br>(SEQ ID NO: 579)<br>(SEQ ID NO: 963) |
| AT3-762 | Target: | 5'-ACUUCAAGGAAAAUGCAGAGCAAUCCA-3'<br>3'-UGAAGUUCCUUUUACGUCUCGUUAGGU-5'<br>5'-ACTTCAAGGAAAATGCAGAGCAATCCA-3' | (SEQ ID NO: 2116)<br>(SEQ ID NO: 580)<br>(SEQ ID NO: 964) |
| AT3-763 | Target: | 5'-CUUCAAGGAAAAUGCAGAGCAAUCCAG-3'<br>3'-GAAGUUCCUUUUACGUCUCGUUAGGUC-5'<br>5'-CTTCAAGGAAAATGCAGAGCAATCCAG-3' | (SEQ ID NO: 2117)<br>(SEQ ID NO: 581)<br>(SEQ ID NO: 965) |
| AT3-764 | Target: | 5'-UUCAAGGAAAAUGCAGAGCAAUCCAGA-3'<br>3'-AAGUUCCUUUUACGUCUCGUUAGGUCU-5'<br>5'-TTCAAGGAAAATGCAGAGCAATCCAGA-3' | (SEQ ID NO: 2118)<br>(SEQ ID NO: 582)<br>(SEQ ID NO: 966) |
| AT3-765 | Target: | 5'-UCAAGGAAAAUGCAGAGCAAUCCAGAG-3'<br>3'-AGUUCCUUUUACGUCUCGUUAGGUCUC-5'<br>5'-TCAAGGAAAATGCAGAGCAATCCAGAG-3' | (SEQ ID NO: 2119)<br>(SEQ ID NO: 583)<br>(SEQ ID NO: 967) |
| AT3-794 | Target: | 5'-GCCAUCAACAAAUGGGUGUCCAAUAAG-3'<br>3'-CGGUAGUUGUUUACCCACAGGUUAUUC-5'<br>5'-GCCATCAACAAATGGGTGTCCAATAAG-3' | (SEQ ID NO: 2120)<br>(SEQ ID NO: 584)<br>(SEQ ID NO: 968) |
| AT3-795 | Target: | 5'-CCAUCAACAAAUGGGUGUCCAAUAAGA-3'<br>3'-GGUAGUUGUUUACCCACAGGUUAUUCU-5'<br>5'-CCATCAACAAATGGGTGTCCAATAAGA-3' | (SEQ ID NO: 2121)<br>(SEQ ID NO: 585)<br>(SEQ ID NO: 969) |
| AT3-800 | Target: | 5'-AACAAAUGGGUGUCCAAUAAGACCGAA-3'<br>3'-UUGUUUACCCACAGGUUAUUCUGGCUU-5'<br>5'-AACAAATGGGTGTCCAATAAGACCGAA-3' | (SEQ ID NO: 2122)<br>(SEQ ID NO: 586)<br>(SEQ ID NO: 970) |
| AT3-864 | Target: | 5'-AUGAGCUCACUGUUCUGGUGCUGGUUA-3'<br>3'-UACUCGAGUGACAAGACCACGACCAAU-5'<br>5'-ATGAGCTCACTGTTCTGGTGCTGGTTA-3' | (SEQ ID NO: 2123)<br>(SEQ ID NO: 587)<br>(SEQ ID NO: 971) |

TABLE 5-continued

Selected Human Anti-AT3 "Blunt/Blunt" DsiRNAs

|  |  |  |
|---|---|---|
| AT3-866 Target: | 5'-GAGCUCACUGUUCUGGUGCUGGUUAAC-3'<br>3'-CUCGAGUGACAAGACCACGACCAAUUG-5'<br>5'-GAGCTCACTGTTCTGGTGCTGGTTAAC-3' | (SEQ ID NO: 2124)<br>(SEQ ID NO: 588)<br>(SEQ ID NO: 972) |
| AT3-867 Target: | 5'-AGCUCACUGUUCUGGUGCUGGUUAACA-3'<br>3'-UCGAGUGACAAGACCACGACCAAUUGU-5'<br>5'-AGCTCACTGTTCTGGTGCTGGTTAACA-3' | (SEQ ID NO: 2125)<br>(SEQ ID NO: 589)<br>(SEQ ID NO: 973) |
| AT3-868 Target: | 5'-GCUCACUGUUCUGGUGCUGGUUAACAC-3'<br>3'-CGAGUGACAAGACCACGACCAAUUGUG-5'<br>5'-GCTCACTGTTCTGGTGCTGGTTAACAC-3' | (SEQ ID NO: 2126)<br>(SEQ ID NO: 590)<br>(SEQ ID NO: 974) |
| AT3-869 Target: | 5'-CUCACUGUUCUGGUGCUGGUUAACACC-3'<br>3'-GAGUGACAAGACCACGACCAAUUGUGG-5'<br>5'-CTCACTGTTCTGGTGCTGGTTAACACC-3' | (SEQ ID NO: 2127)<br>(SEQ ID NO: 591)<br>(SEQ ID NO: 975) |
| AT3-870 Target: | 5'-UCACUGUUCUGGUGCUGGUUAACACCA-3'<br>3'-AGUGACAAGACCACGACCAAUUGUGGU-5'<br>5'-TCACTGTTCTGGTGCTGGTTAACACCA-3' | (SEQ ID NO: 2128)<br>(SEQ ID NO: 592)<br>(SEQ ID NO: 976) |
| AT3-871 Target: | 5'-CACUGUUCUGGUGCUGGUUAACACCAU-3'<br>3'-GUGACAAGACCACGACCAAUUGUGGUA-5'<br>5'-CACTGTTCTGGTGCTGGTTAACACCAT-3' | (SEQ ID NO: 2129)<br>(SEQ ID NO: 593)<br>(SEQ ID NO: 977) |
| AT3-872 Target: | 5'-ACUGUUCUGGUGCUGGUUAACACCAUU-3'<br>3'-UGACAAGACCACGACCAAUUGUGGUAA-5'<br>5'-ACTGTTCTGGTGCTGGTTAACACCATT-3' | (SEQ ID NO: 2130)<br>(SEQ ID NO: 594)<br>(SEQ ID NO: 978) |
| AT3-873 Target: | 5'-CUGUUCUGGUGCUGGUUAACACCAUUU-3'<br>3'-GACAAGACCACGACCAAUUGUGGUAAA-5'<br>5'-CTGTTCTGGTGCTGGTTAACACCATTT-3' | (SEQ ID NO: 2131)<br>(SEQ ID NO: 595)<br>(SEQ ID NO: 979) |
| AT3-874 Target: | 5'-UGUUCUGGUGCUGGUUAACACCAUUUA-3'<br>3'-ACAAGACCACGACCAAUUGUGGUAAAU-5'<br>5'-TGTTCTGGTGCTGGTTAACACCATTTA-3' | (SEQ ID NO: 2132)<br>(SEQ ID NO: 596)<br>(SEQ ID NO: 980) |
| AT3-875 Target: | 5'-GUUCUGGUGCUGGUUAACACCAUUUAC-3'<br>3'-CAAGACCACGACCAAUUGUGGUAAAUG-5'<br>5'-GTTCTGGTGCTGGTTAACACCATTTAC-3' | (SEQ ID NO: 2133)<br>(SEQ ID NO: 597)<br>(SEQ ID NO: 981) |
| AT3-876 Target: | 5'-UUCUGGUGCUGGUUAACACCAUUUACU-3'<br>3'-AAGACCACGACCAAUUGUGGUAAAUGA-5'<br>5'-TTCTGGTGCTGGTTAACACCATTTACT-3' | (SEQ ID NO: 2134)<br>(SEQ ID NO: 598)<br>(SEQ ID NO: 982) |
| AT3-877 Target: | 5'-UCUGGUGCUGGUUAACACCAUUUACUU-3'<br>3'-AGACCACGACCAAUUGUGGUAAAUGAA-5'<br>5'-TCTGGTGCTGGTTAACACCATTTACTT-3' | (SEQ ID NO: 2135)<br>(SEQ ID NO: 599)<br>(SEQ ID NO: 983) |
| AT3-878 Target: | 5'-CUGGUGCUGGUUAACACCAUUUACUUC-3'<br>3'-GACCACGACCAAUUGUGGUAAAUGAAG-5'<br>5'-CTGGTGCTGGTTAACACCATTTACTTC-3' | (SEQ ID NO: 2136)<br>(SEQ ID NO: 600)<br>(SEQ ID NO: 984) |
| AT3-879 Target: | 5'-UGGUGCUGGUUAACACCAUUUACUUCA-3'<br>3'-ACCACGACCAAUUGUGGUAAAUGAAGU-5'<br>5'-TGGTGCTGGTTAACACCATTTACTTCA-3' | (SEQ ID NO: 2137)<br>(SEQ ID NO: 601)<br>(SEQ ID NO: 985) |
| AT3-880 Target: | 5'-GGUGCUGGUUAACACCAUUUACUUCAA-3'<br>3'-CCACGACCAAUUGUGGUAAAUGAAGUU-5'<br>5'-GGTGCTGGTTAACACCATTTACTTCAA-3' | (SEQ ID NO: 2138)<br>(SEQ ID NO: 602)<br>(SEQ ID NO: 986) |
| AT3-881 Target: | 5'-GUGCUGGUUAACACCAUUUACUUCAAG-3'<br>3'-CACGACCAAUUGUGGUAAAUGAAGUUC-5'<br>5'-GTGCTGGTTAACACCATTTACTTCAAG-3' | (SEQ ID NO: 2139)<br>(SEQ ID NO: 603)<br>(SEQ ID NO: 987) |
| AT3-882 Target: | 5'-UGCUGGUUAACACCAUUUACUUCAAGG-3'<br>3'-ACGACCAAUUGUGGUAAAUGAAGUUCC-5'<br>5'-TGCTGGTTAACACCATTTACTTCAAGG-3' | (SEQ ID NO: 2140)<br>(SEQ ID NO: 604)<br>(SEQ ID NO: 988) |
| AT3-883 Target: | 5'-GCUGGUUAACACCAUUUACUUCAAGGG-3'<br>3'-CGACCAAUUGUGGUAAAUGAAGUUCCC-5'<br>5'-GCTGGTTAACACCATTTACTTCAAGGG-3' | (SEQ ID NO: 2141)<br>(SEQ ID NO: 605)<br>(SEQ ID NO: 989) |
| AT3-884 Target: | 5'-CUGGUUAACACCAUUUACUUCAAGGGC-3'<br>3'-GACCAAUUGUGGUAAAUGAAGUUCCCG-5'<br>5'-CTGGTTAACACCATTTACTTCAAGGGC-3' | (SEQ ID NO: 2142)<br>(SEQ ID NO: 606)<br>(SEQ ID NO: 990) |

TABLE 5-continued

Selected Human Anti-AT3 "Blunt/Blunt" DsiRNAs

| | | |
|---|---|---|
| AT3-885 Target: | 5'-UGGUUAACACCAUUUACUUCAAGGGCC-3'<br>3'-ACCAAUUGUGGUAAAUGAAGUUCCCGG-5'<br>5'-TGGTTAACACCATTTACTTCAAGGGCC-3' | (SEQ ID NO: 2143)<br>(SEQ ID NO: 607)<br>(SEQ ID NO: 991) |
| AT3-886 Target: | 5'-GGUUAACACCAUUUACUUCAAGGGCCU-3'<br>3'-CCAAUUGUGGUAAAUGAAGUUCCCGGA-5'<br>5'-GGTTAACACCATTTACTTCAAGGGCCT-3' | (SEQ ID NO: 2144)<br>(SEQ ID NO: 608)<br>(SEQ ID NO: 992) |
| AT3-887 Target: | 5'-GUUAACACCAUUUACUUCAAGGGCCUG-3'<br>3'-CAAUUGUGGUAAAUGAAGUUCCCGGAC-5'<br>5'-GTTAACACCATTTACTTCAAGGGCCTG-3' | (SEQ ID NO: 2145)<br>(SEQ ID NO: 609)<br>(SEQ ID NO: 993) |
| AT3-888 Target: | 5'-UUAACACCAUUUACUUCAAGGGCCUGU-3'<br>3'-AAUUGUGGUAAAUGAAGUUCCCGGACA-5'<br>5'-TTAACACCATTTACTTCAAGGGCCTGT-3' | (SEQ ID NO: 2146)<br>(SEQ ID NO: 610)<br>(SEQ ID NO: 994) |
| AT3-889 Target: | 5'-UAACACCAUUUACUUCAAGGGCCUGUG-3'<br>3'-AUUGUGGUAAAUGAAGUUCCCGGACAC-5'<br>5'-TAACACCATTTACTTCAAGGGCCTGTG-3' | (SEQ ID NO: 2147)<br>(SEQ ID NO: 611)<br>(SEQ ID NO: 995) |
| AT3-890 Target: | 5'-AACACCAUUUACUUCAAGGGCCUGUGG-3'<br>3'-UUGUGGUAAAUGAAGUUCCCGGACACC-5'<br>5'-AACACCATTTACTTCAAGGGCCTGTGG-3' | (SEQ ID NO: 2148)<br>(SEQ ID NO: 612)<br>(SEQ ID NO: 996) |
| AT3-891 Target: | 5'-ACACCAUUUACUUCAAGGGCCUGUGGA-3'<br>3'-UGUGGUAAAUGAAGUUCCCGGACACCU-5'<br>5'-ACACCATTTACTTCAAGGGCCTGTGGA-3' | (SEQ ID NO: 2149)<br>(SEQ ID NO: 613)<br>(SEQ ID NO: 997) |
| AT3-892 Target: | 5'-CACCAUUUACUUCAAGGGCCUGUGGAA-3'<br>3'-GUGGUAAAUGAAGUUCCCGGACACCUU-5'<br>5'-CACCATTTACTTCAAGGGCCTGTGGAA-3' | (SEQ ID NO: 2150)<br>(SEQ ID NO: 614)<br>(SEQ ID NO: 998) |
| AT3-893 Target: | 5'-ACCAUUUACUUCAAGGGCCUGUGGAAG-3'<br>3'-UGGUAAAUGAAGUUCCCGGACACCUUC-5'<br>5'-ACCATTTACTTCAAGGGCCTGTGGAAG-3' | (SEQ ID NO: 2151)<br>(SEQ ID NO: 615)<br>(SEQ ID NO: 999) |
| AT3-894 Target: | 5'-CCAUUUACUUCAAGGGCCUGUGGAAGU-3'<br>3'-GGUAAAUGAAGUUCCCGGACACCUUCA-5'<br>5'-CCATTTACTTCAAGGGCCTGTGGAAGT-3' | (SEQ ID NO: 2152)<br>(SEQ ID NO: 616)<br>(SEQ ID NO: 1000) |
| AT3-895 Target: | 5'-CAUUUACUUCAAGGGCCUGUGGAAGUC-3'<br>3'-GUAAAUGAAGUUCCCGGACACCUUCAG-5'<br>5'-CATTTACTTCAAGGGCCTGTGGAAGTC-3' | (SEQ ID NO: 2153)<br>(SEQ ID NO: 617)<br>(SEQ ID NO: 1001) |
| AT3-896 Target: | 5'-AUUUACUUCAAGGGCCUGUGGAAGUCA-3'<br>3'-UAAAUGAAGUUCCCGGACACCUUCAGU-5'<br>5'-ATTTACTTCAAGGGCCTGTGGAAGTCA-3' | (SEQ ID NO: 2154)<br>(SEQ ID NO: 618)<br>(SEQ ID NO: 1002) |
| AT3-897 Target: | 5'-UUUACUUCAAGGGCCUGUGGAAGUCAA-3'<br>3'-AAAUGAAGUUCCCGGACACCUUCAGUU-5'<br>5'-TTTACTTCAAGGGCCTGTGGAAGTCAA-3' | (SEQ ID NO: 2155)<br>(SEQ ID NO: 619)<br>(SEQ ID NO: 1003) |
| AT3-898 Target: | 5'-UUACUUCAAGGGCCUGUGGAAGUCAAA-3'<br>3'-AAUGAAGUUCCCGGACACCUUCAGUUU-5'<br>5'-TTACTTCAAGGGCCTGTGGAAGTCAAA-3' | (SEQ ID NO: 2156)<br>(SEQ ID NO: 620)<br>(SEQ ID NO: 1004) |
| AT3-899 Target: | 5'-UACUUCAAGGGCCUGUGGAAGUCAAAG-3'<br>3'-AUGAAGUUCCCGGACACCUUCAGUUUC-5'<br>5'-TACTTCAAGGGCCTGTGGAAGTCAAAG-3' | (SEQ ID NO: 2157)<br>(SEQ ID NO: 621)<br>(SEQ ID NO: 1005) |
| AT3-900 Target: | 5'-ACUUCAAGGGCCUGUGGAAGUCAAAGU-3'<br>3'-UGAAGUUCCCGGACACCUUCAGUUUCA-5'<br>5'-ACTTCAAGGGCCTGTGGAAGTCAAAGT-3' | (SEQ ID NO: 2158)<br>(SEQ ID NO: 622)<br>(SEQ ID NO: 1006) |
| AT3-901 Target: | 5'-CUUCAAGGGCCUGUGGAAGUCAAAGUU-3'<br>3'-GAAGUUCCCGGACACCUUCAGUUUCAA-5'<br>5'-CTTCAAGGGCCTGTGGAAGTCAAAGTT-3' | (SEQ ID NO: 2159)<br>(SEQ ID NO: 623)<br>(SEQ ID NO: 1007) |
| AT3-902 Target: | 5'-UUCAAGGGCCUGUGGAAGUCAAAGUUC-3'<br>3'-AAGUUCCCGGACACCUUCAGUUUCAAG-5'<br>5'-TTCAAGGGCCTGTGGAAGTCAAAGTTC-3' | (SEQ ID NO: 2160)<br>(SEQ ID NO: 624)<br>(SEQ ID NO: 1008) |
| AT3-903 Target: | 5'-UCAAGGGCCUGUGGAAGUCAAAGUUCA-3'<br>3'-AGUUCCCGGACACCUUCAGUUUCAAGU-5'<br>5'-TCAAGGGCCTGTGGAAGTCAAAGTTCA-3' | (SEQ ID NO: 2161)<br>(SEQ ID NO: 625)<br>(SEQ ID NO: 1009) |

TABLE 5-continued

Selected Human Anti-AT3 "Blunt/Blunt" DsiRNAs

| | | |
|---|---|---|
| AT3-904 Target: | 5'-CAAGGGCCUGUGGAAGUCAAAGUUCAG-3'<br>3'-GUUCCCGGACACCUUCAGUUUCAAGUC-5'<br>5'-CAAGGGCCTGTGGAAGTCAAAGTTCAG-3' | (SEQ ID NO: 2162)<br>(SEQ ID NO: 626)<br>(SEQ ID NO: 1010) |
| AT3-905 Target: | 5'-AAGGGCCUGUGGAAGUCAAAGUUCAGC-3'<br>3'-UUCCCGGACACCUUCAGUUUCAAGUCG-5'<br>5'-AAGGGCCTGTGGAAGTCAAAGTTCAGC-3' | (SEQ ID NO: 2163)<br>(SEQ ID NO: 627)<br>(SEQ ID NO: 1011) |
| AT3-906 Target: | 5'-AGGGCCUGUGGAAGUCAAAGUUCAGCC-3'<br>3'-UCCCGGACACCUUCAGUUUCAAGUCGG-5'<br>5'-AGGGCCTGTGGAAGTCAAAGTTCAGCC-3' | (SEQ ID NO: 2164)<br>(SEQ ID NO: 628)<br>(SEQ ID NO: 1012) |
| AT3-907 Target: | 5'-GGGCCUGUGGAAGUCAAAGUUCAGCCC-3'<br>3'-CCCGGACACCUUCAGUUUCAAGUCGGG-5'<br>5'-GGGCCTGTGGAAGTCAAAGTTCAGCCC-3' | (SEQ ID NO: 2165)<br>(SEQ ID NO: 629)<br>(SEQ ID NO: 1013) |
| AT3-908 Target: | 5'-GGCCUGUGGAAGUCAAAGUUCAGCCCU-3'<br>3'-CCGGACACCUUCAGUUUCAAGUCGGGA-5'<br>5'-GGCCTGTGGAAGTCAAAGTTCAGCCCT-3' | (SEQ ID NO: 2166)<br>(SEQ ID NO: 630)<br>(SEQ ID NO: 1014) |
| AT3-909 Target: | 5'-GCCUGUGGAAGUCAAAGUUCAGCCCUG-3'<br>3'-CGGACACCUUCAGUUUCAAGUCGGGAC-5'<br>5'-GCCTGTGGAAGTCAAAGTTCAGCCCTG-3' | (SEQ ID NO: 2167)<br>(SEQ ID NO: 631)<br>(SEQ ID NO: 1015) |
| AT3-910 Target: | 5'-CCUGUGGAAGUCAAAGUUCAGCCCUGA-3'<br>3'-GGACACCUUCAGUUUCAAGUCGGGACU-5'<br>5'-CCTGTGGAAGTCAAAGTTCAGCCCTGA-3' | (SEQ ID NO: 2168)<br>(SEQ ID NO: 632)<br>(SEQ ID NO: 1016) |
| AT3-911 Target: | 5'-CUGUGGAAGUCAAAGUUCAGCCCUGAG-3'<br>3'-GACACCUUCAGUUUCAAGUCGGGACUC-5'<br>5'-CTGTGGAAGTCAAAGTTCAGCCCTGAG-3' | (SEQ ID NO: 2169)<br>(SEQ ID NO: 633)<br>(SEQ ID NO: 1017) |
| AT3-912 Target: | 5'-UGUGGAAGUCAAAGUUCAGCCCUGAGA-3'<br>3'-ACACCUUCAGUUUCAAGUCGGGACUCU-5'<br>5'-TGTGGAAGTCAAAGTTCAGCCCTGAGA-3' | (SEQ ID NO: 2170)<br>(SEQ ID NO: 634)<br>(SEQ ID NO: 1018) |
| AT3-913 Target: | 5'-GUGGAAGUCAAAGUUCAGCCCUGAGAA-3'<br>3'-CACCUUCAGUUUCAAGUCGGGACUCUU-5'<br>5'-GTGGAAGTCAAAGTTCAGCCCTGAGAA-3' | (SEQ ID NO: 2171)<br>(SEQ ID NO: 635)<br>(SEQ ID NO: 1019) |
| AT3-914 Target: | 5'-UGGAAGUCAAAGUUCAGCCCUGAGAAC-3'<br>3'-ACCUUCAGUUUCAAGUCGGGACUCUUG-5'<br>5'-TGGAAGTCAAAGTTCAGCCCTGAGAAC-3' | (SEQ ID NO: 2172)<br>(SEQ ID NO: 636)<br>(SEQ ID NO: 1020) |
| AT3-915 Target: | 5'-GGAAGUCAAAGUUCAGCCCUGAGAACA-3'<br>3'-CCUUCAGUUUCAAGUCGGGACUCUUGU-5'<br>5'-GGAAGTCAAAGTTCAGCCCTGAGAACA-3' | (SEQ ID NO: 2173)<br>(SEQ ID NO: 637)<br>(SEQ ID NO: 1021) |
| AT3-916 Target: | 5'-GAAGUCAAAGUUCAGCCCUGAGAACAC-3'<br>3'-CUUCAGUUUCAAGUCGGGACUCUUGUG-5'<br>5'-GAAGTCAAAGTTCAGCCCTGAGAACAC-3' | (SEQ ID NO: 2174)<br>(SEQ ID NO: 638)<br>(SEQ ID NO: 1022) |
| AT3-959 Target: | 5'-UACAAGGCUGAUGGAGAGUCGUGUUCA-3'<br>3'-AUGUUCCGACUACCUCUCAGCACAAGU-5'<br>5'-TACAAGGCTGATGGAGAGTCGTGTTCA-3' | (SEQ ID NO: 2175)<br>(SEQ ID NO: 639)<br>(SEQ ID NO: 1023) |
| AT3-966 Target: | 5'-CUGAUGGAGAGUCGUGUUCAGCAUCUA-3'<br>3'-GACUACCUCUCAGCACAAGUCGUAGAU-5'<br>5'-CTGATGGAGAGTCGTGTTCAGCATCTA-3' | (SEQ ID NO: 2176)<br>(SEQ ID NO: 640)<br>(SEQ ID NO: 1024) |
| AT3-967 Target: | 5'-UGAUGGAGAGUCGUGUUCAGCAUCUAU-3'<br>3'-ACUACCUCUCAGCACAAGUCGUAGAUA-5'<br>5'-TGATGGAGAGTCGTGTTCAGCATCTAT-3' | (SEQ ID NO: 2177)<br>(SEQ ID NO: 641)<br>(SEQ ID NO: 1025) |
| AT3-988 Target: | 5'-AUCUAUGAUGUACCAGGAAGGCAAGUU-3'<br>3'-UAGAUACUACAUGGUCCUUCCGUUCAA-5'<br>5'-ATCTATGATGTACCAGGAAGGCAAGTT-3' | (SEQ ID NO: 2178)<br>(SEQ ID NO: 642)<br>(SEQ ID NO: 1026) |
| AT3-989 Target: | 5'-UCUAUGAUGUACCAGGAAGGCAAGUUC-3'<br>3'-AGAUACUACAUGGUCCUUCCGUUCAAG-5'<br>5'-TCTATGATGTACCAGGAAGGCAAGTTC-3' | (SEQ ID NO: 2179)<br>(SEQ ID NO: 643)<br>(SEQ ID NO: 1027) |
| AT3-990 Target: | 5'-CUAUGAUGUACCAGGAAGGCAAGUUCC-3'<br>3'-GAUACUACAUGGUCCUUCCGUUCAAGG-5'<br>5'-CTATGATGTACCAGGAAGGCAAGTTCC-3' | (SEQ ID NO: 2180)<br>(SEQ ID NO: 644)<br>(SEQ ID NO: 1028) |

TABLE 5-continued

Selected Human Anti-AT3 "Blunt/Blunt" DsiRNAs

| | | |
|---|---|---|
| | 5'-UAUGAUGUACCAGGAAGGCAAGUUCCG-3' | (SEQ ID NO: 2181) |
| | 3'-AUACUACAUGGUCCUUCCGUUCAAGGC-5' | (SEQ ID NO: 645) |
| AT3-991 Target: | 5'-TATGATGTACCAGGAAGGCAAGTTCCG-3' | (SEQ ID NO: 1029) |
| | 5'-UGAUGUACCAGGAAGGCAAGUUCCGUU-3' | (SEQ ID NO: 2182) |
| | 3'-ACUACAUGGUCCUUCCGUUCAAGGCAA-5' | (SEQ ID NO: 646) |
| AT3-993 Target: | 5'-TGATGTACCAGGAAGGCAAGTTCCGTT-3' | (SEQ ID NO: 1030) |
| | 5'-ACCCAGGUGCUUGAGUUGCCCUUCAAA-3' | (SEQ ID NO: 2183) |
| | 3'-UGGGUCCACGAACUCAACGGGAAGUUU-5' | (SEQ ID NO: 647) |
| AT3-1040 Target: | 5'-ACCCAGGTGCTTGAGTTGCCCTTCAAA-3' | (SEQ ID NO: 1031) |
| | 5'-CAGGUGCUUGAGUUGCCCUUCAAAGGU-3' | (SEQ ID NO: 2184) |
| | 3'-GUCCACGAACUCAACGGGAAGUUUCCA-5' | (SEQ ID NO: 648) |
| AT3-1043 Target: | 5'-CAGGTGCTTGAGTTGCCCTTCAAAGGT-3' | (SEQ ID NO: 1032) |
| | 5'-AGGUGCUUGAGUUGCCCUUCAAAGGUG-3' | (SEQ ID NO: 2185) |
| | 3'-UCCACGAACUCAACGGGAAGUUUCCAC-5' | (SEQ ID NO: 649) |
| AT3-1044 Target: | 5'-AGGTGCTTGAGTTGCCCTTCAAAGGTG-3' | (SEQ ID NO: 1033) |
| | 5'-GGUGCUUGAGUUGCCCUUCAAAGGUGA-3' | (SEQ ID NO: 2186) |
| | 3'-CCACGAACUCAACGGGAAGUUUCCACU-5' | (SEQ ID NO: 650) |
| AT3-1045 Target: | 5'-GGTGCTTGAGTTGCCCTTCAAAGGTGA-3' | (SEQ ID NO: 1034) |
| | 5'-AAGGUGAUGACAUCACCAUGGUCCUCA-3' | (SEQ ID NO: 2187) |
| | 3'-UUCCACUACUGUAGUGGUACCAGGAGU-5' | (SEQ ID NO: 651) |
| AT3-1065 Target: | 5'-AAGGTGATGACATCACCATGGTCCTCA-3' | (SEQ ID NO: 1035) |
| | 5'-AGGUGAUGACAUCACCAUGGUCCUCAU-3' | (SEQ ID NO: 2188) |
| | 3'-UCCACUACUGUAGUGGUACCAGGAGUA-5' | (SEQ ID NO: 652) |
| AT3-1066 Target: | 5'-AGGTGATGACATCACCATGGTCCTCAT-3' | (SEQ ID NO: 1036) |
| | 5'-CUUGCCCAAGCCUGAGAAGAGCCUGGC-3' | (SEQ ID NO: 2189) |
| | 3'-GAACGGGUUCGGACUCUUCUCGGACCG-5' | (SEQ ID NO: 653) |
| AT3-1093 Target: | 5'-CTTGCCCAAGCCTGAGAAGAGCCTGGC-3' | (SEQ ID NO: 1037) |
| | 5'-UUGCCCAAGCCUGAGAAGAGCCUGGCC-3' | (SEQ ID NO: 2190) |
| | 3'-AACGGGUUCGGACUCUUCUCGGACCGG-5' | (SEQ ID NO: 654) |
| AT3-1094 Target: | 5'-TTGCCCAAGCCTGAGAAGAGCCTGGCC-3' | (SEQ ID NO: 1038) |
| | 5'-UGCCCAAGCCUGAGAAGAGCCUGGCCA-3' | (SEQ ID NO: 2191) |
| | 3'-ACGGGUUCGGACUCUUCUCGGACCGGU-5' | (SEQ ID NO: 655) |
| AT3-1095 Target: | 5'-TGCCCAAGCCTGAGAAGAGCCTGGCCA-3' | (SEQ ID NO: 1039) |
| | 5'-GCCCAAGCCUGAGAAGAGCCUGGCCAA-3' | (SEQ ID NO: 2192) |
| | 3'-CGGGUUCGGACUCUUCUCGGACCGGUU-5' | (SEQ ID NO: 656) |
| AT3-1096 Target: | 5'-GCCCAAGCCTGAGAAGAGCCTGGCCAA-3' | (SEQ ID NO: 1040) |
| | 5'-CCCAAGCCUGAGAAGAGCCUGGCCAAG-3' | (SEQ ID NO: 2193) |
| | 3'-GGGUUCGGACUCUUCUCGGACCGGUUC-5' | (SEQ ID NO: 657) |
| AT3-1097 Target: | 5'-CCCAAGCCTGAGAAGAGCCTGGCCAAG-3' | (SEQ ID NO: 1041) |
| | 5'-CCAAGCCUGAGAAGAGCCUGGCCAAGG-3' | (SEQ ID NO: 2194) |
| | 3'-GGUUCGGACUCUUCUCGGACCGGUUCC-5' | (SEQ ID NO: 658) |
| AT3-1098 Target: | 5'-CCAAGCCTGAGAAGAGCCTGGCCAAGG-3' | (SEQ ID NO: 1042) |
| | 5'-CAAGCCUGAGAAGAGCCUGGCCAAGGU-3' | (SEQ ID NO: 2195) |
| | 3'-GUUCGGACUCUUCUCGGACCGGUUCCA-5' | (SEQ ID NO: 659) |
| AT3-1099 Target: | 5'-CAAGCCTGAGAAGAGCCTGGCCAAGGT-3' | (SEQ ID NO: 1043) |
| | 5'-AAGCCUGAGAAGAGCCUGGCCAAGGUA-3' | (SEQ ID NO: 2196) |
| | 3'-UUCGGACUCUUCUCGGACCGGUUCCAU-5' | (SEQ ID NO: 660) |
| AT3-1100 Target: | 5'-AAGCCTGAGAAGAGCCTGGCCAAGGTA-3' | (SEQ ID NO: 1044) |
| | 5'-AGCCUGAGAAGAGCCUGGCCAAGGUAG-3' | (SEQ ID NO: 2197) |
| | 3'-UCGGACUCUUCUCGGACCGGUUCCAUC-5' | (SEQ ID NO: 661) |
| AT3-1101 Target: | 5'-AGCCTGAGAAGAGCCTGGCCAAGGTAG-3' | (SEQ ID NO: 1045) |
| | 5'-GCCUGAGAAGAGCCUGGCCAAGGUAGA-3' | (SEQ ID NO: 2198) |
| | 3'-CGGACUCUUCUCGGACCGGUUCCAUCU-5' | (SEQ ID NO: 662) |
| AT3-1102 Target: | 5'-GCCTGAGAAGAGCCTGGCCAAGGTAGA-3' | (SEQ ID NO: 1046) |
| | 5'-CCUGAGAAGAGCCUGGCCAAGGUAGAG-3' | (SEQ ID NO: 2199) |
| | 3'-GGACUCUUCUCGGACCGGUUCCAUCUC-5' | (SEQ ID NO: 663) |
| AT3-1103 Target: | 5'-CCTGAGAAGAGCCTGGCCAAGGTAGAG-3' | (SEQ ID NO: 1047) |

TABLE 5-continued

Selected Human Anti-AT3 "Blunt/Blunt" DsiRNAs

|             |         |                                      |                   |
|-------------|---------|--------------------------------------|-------------------|
|             |         | 5'-CUGAGAAGAGCCUGGCCAAGGUAGAGA-3'    | (SEQ ID NO: 2200) |
|             |         | 3'-GACUCUUCUCGGACCGGUUCCAUCUCU-5'    | (SEQ ID NO: 664)  |
| AT3-1104    | Target: | 5'-CTGAGAAGAGCCTGGCCAAGGTAGAGA-3'    | (SEQ ID NO: 1048) |
|             |         | 5'-UGAGAAGAGCCUGGCCAAGGUAGAGAA-3'    | (SEQ ID NO: 2201) |
|             |         | 3'-ACUCUUCUCGGACCGGUUCCAUCUCUU-5'    | (SEQ ID NO: 665)  |
| AT3-1105    | Target: | 5'-TGAGAAGAGCCTGGCCAAGGTAGAGAA-3'    | (SEQ ID NO: 1049) |
|             |         | 5'-UGGUGGUCCACAUGCCCCGCUUCCGCA-3'    | (SEQ ID NO: 2202) |
|             |         | 3'-ACCACCAGGUGUACGGGGCGAAGGCGU-5'    | (SEQ ID NO: 666)  |
| AT3-1188    | Target: | 5'-TGGTGGTCCACATGCCCCGCTTCCGCA-3'    | (SEQ ID NO: 1050) |
|             |         | 5'-GGUGGUCCACAUGCCCCGCUUCCGCAU-3'    | (SEQ ID NO: 2203) |
|             |         | 3'-CCACCAGGUGUACGGGGCGAAGGCGUA-5'    | (SEQ ID NO: 667)  |
| AT3-1189    | Target: | 5'-GGTGGTCCACATGCCCCGCTTCCGCAT-3'    | (SEQ ID NO: 1051) |
|             |         | 5'-GUGGUCCACAUGCCCCGCUUCCGCAUU-3'    | (SEQ ID NO: 2204) |
|             |         | 3'-CACCAGGUGUACGGGGCGAAGGCGUAA-5'    | (SEQ ID NO: 668)  |
| AT3-1190    | Target: | 5'-GTGGTCCACATGCCCCGCTTCCGCATT-3'    | (SEQ ID NO: 1052) |
|             |         | 5'-UGGUCCACAUGCCCCGCUUCCGCAUUG-3'    | (SEQ ID NO: 2205) |
|             |         | 3'-ACCAGGUGUACGGGGCGAAGGCGUAAC-5'    | (SEQ ID NO: 669)  |
| AT3-1191    | Target: | 5'-TGGTCCACATGCCCCGCTTCCGCATTG-3'    | (SEQ ID NO: 1053) |
|             |         | 5'-GGUCCACAUGCCCCGCUUCCGCAUUGA-3'    | (SEQ ID NO: 2206) |
|             |         | 3'-CCAGGUGUACGGGGCGAAGGCGUAACU-5'    | (SEQ ID NO: 670)  |
| AT3-1192    | Target: | 5'-GGTCCACATGCCCCGCTTCCGCATTGA-3'    | (SEQ ID NO: 1054) |
|             |         | 5'-GUCCACAUGCCCCGCUUCCGCAUUGAG-3'    | (SEQ ID NO: 2207) |
|             |         | 3'-CAGGUGUACGGGGCGAAGGCGUAACUC-5'    | (SEQ ID NO: 671)  |
| AT3-1193    | Target: | 5'-GTCCACATGCCCCGCTTCCGCATTGAG-3'    | (SEQ ID NO: 1055) |
|             |         | 5'-UCCACAUGCCCCGCUUCCGCAUUGAGG-3'    | (SEQ ID NO: 2208) |
|             |         | 3'-AGGUGUACGGGGCGAAGGCGUAACUCC-5'    | (SEQ ID NO: 672)  |
| AT3-1194    | Target: | 5'-TCCACATGCCCCGCTTCCGCATTGAGG-3'    | (SEQ ID NO: 1056) |
|             |         | 5'-UCAGUUUGAAGGAGCAGCUGCAAGACA-3'    | (SEQ ID NO: 2209) |
|             |         | 3'-AGUCAAACUUCCUCGUCGACGUUCUGU-5'    | (SEQ ID NO: 673)  |
| AT3-1227    | Target: | 5'-TCAGTTTGAAGGAGCAGCTGCAAGACA-3'    | (SEQ ID NO: 1057) |
|             |         | 5'-CAGUUUGAAGGAGCAGCUGCAAGACAU-3'    | (SEQ ID NO: 2210) |
|             |         | 3'-GUCAAACUUCCUCGUCGACGUUCUGUA-5'    | (SEQ ID NO: 674)  |
| AT3-1228    | Target: | 5'-CAGTTTGAAGGAGCAGCTGCAAGACAT-3'    | (SEQ ID NO: 1058) |
|             |         | 5'-UUUGAAGGAGCAGCUGCAAGACAUGGG-3'    | (SEQ ID NO: 2211) |
|             |         | 3'-AAACUUCCUCGUCGACGUUCUGUACCC-5'    | (SEQ ID NO: 675)  |
| AT3-1231    | Target: | 5'-TTTGAAGGAGCAGCTGCAAGACATGGG-3'    | (SEQ ID NO: 1059) |
|             |         | 5'-UUGAAGGAGCAGCUGCAAGACAUGGGC-3'    | (SEQ ID NO: 2212) |
|             |         | 3'-AACUUCCUCGUCGACGUUCUGUACCCG-5'    | (SEQ ID NO: 676)  |
| AT3-1232    | Target: | 5'-TTGAAGGAGCAGCTGCAAGACATGGGC-3'    | (SEQ ID NO: 1060) |
|             |         | 5'-UGAAGGAGCAGCUGCAAGACAUGGGCC-3'    | (SEQ ID NO: 2213) |
|             |         | 3'-ACUUCCUCGUCGACGUUCUGUACCCGG-5'    | (SEQ ID NO: 677)  |
| AT3-1233    | Target: | 5'-TGAAGGAGCAGCTGCAAGACATGGGCC-3'    | (SEQ ID NO: 1061) |
|             |         | 5'-GAAGGAGCAGCUGCAAGACAUGGGCCU-3'    | (SEQ ID NO: 2214) |
|             |         | 3'-CUUCCUCGUCGACGUUCUGUACCCGGA-5'    | (SEQ ID NO: 678)  |
| AT3-1234    | Target: | 5'-GAAGGAGCAGCTGCAAGACATGGGCCT-3'    | (SEQ ID NO: 1062) |
|             |         | 5'-AAGGAGCAGCUGCAAGACAUGGGCCUU-3'    | (SEQ ID NO: 2215) |
|             |         | 3'-UUCCUCGUCGACGUUCUGUACCCGGAA-5'    | (SEQ ID NO: 679)  |
| AT3-1235    | Target: | 5'-AAGGAGCAGCTGCAAGACATGGGCCTT-3'    | (SEQ ID NO: 1063) |
|             |         | 5'-AGGAGCAGCUGCAAGACAUGGGCCUUG-3'    | (SEQ ID NO: 2216) |
|             |         | 3'-UCCUCGUCGACGUUCUGUACCCGGAAC-5'    | (SEQ ID NO: 680)  |
| AT3-1236    | Target: | 5'-AGGAGCAGCTGCAAGACATGGGCCTTG-3'    | (SEQ ID NO: 1064) |
|             |         | 5'-GGAGCAGCUGCAAGACAUGGGCCUUGU-3'    | (SEQ ID NO: 2217) |
|             |         | 3'-CCUCGUCGACGUUCUGUACCCGGAACA-5'    | (SEQ ID NO: 681)  |
| AT3-1237    | Target: | 5'-GGAGCAGCTGCAAGACATGGGCCTTGT-3'    | (SEQ ID NO: 1065) |
|             |         | 5'-GAGCAGCUGCAAGACAUGGGCCUUGUC-3'    | (SEQ ID NO: 2218) |
|             |         | 3'-CUCGUCGACGUUCUGUACCCGGAACAG-5'    | (SEQ ID NO: 682)  |
| AT3-1238    | Target: | 5'-GAGCAGCTGCAAGACATGGGCCTTGTC-3'    | (SEQ ID NO: 1066) |

TABLE 5-continued

Selected Human Anti-AT3 "Blunt/Blunt" DsiRNAs

|  |  |  |  |
|---|---|---|---|
|  | 5'-AGCAGCUGCAAGACAUGGGCCUUGUCG-3' | (SEQ ID NO: 2219) |  |
|  | 3'-UCGUCGACGUUCUGUACCCGGAACAGC-5' | (SEQ ID NO: 683) |  |
| AT3-1239 Target: | 5'-AGCAGCTGCAAGACATGGGCCTTGTCG-3' | (SEQ ID NO: 1067) |  |
|  | 5'-GCAGCUGCAAGACAUGGGCCUUGUCGA-3' | (SEQ ID NO: 2220) |  |
|  | 3'-CGUCGACGUUCUGUACCCGGAACAGCU-5' | (SEQ ID NO: 684) |  |
| AT3-1240 Target: | 5'-GCAGCTGCAAGACATGGGCCTTGTCGA-3' | (SEQ ID NO: 1068) |  |
|  | 5'-CCUUGUCGAUCUGUUCAGCCCUGAAAA-3' | (SEQ ID NO: 2221) |  |
|  | 3'-GGAACAGCUAGACAAGUCGGGACUUUU-5' | (SEQ ID NO: 685) |  |
| AT3-1258 Target: | 5'-CCTTGTCGATCTGTTCAGCCCTGAAAA-3' | (SEQ ID NO: 1069) |  |
|  | 5'-UUGUCGAUCUGUUCAGCCCUGAAAAGU-3' | (SEQ ID NO: 2222) |  |
|  | 3'-AACAGCUAGACAAGUCGGGACUUUUCA-5' | (SEQ ID NO: 686) |  |
| AT3-1260 Target: | 5'-TTGTCGATCTGTTCAGCCCTGAAAAGT-3' | (SEQ ID NO: 1070) |  |
|  | 5'-UGUCGAUCUGUUCAGCCCUGAAAAGUC-3' | (SEQ ID NO: 2223) |  |
|  | 3'-ACAGCUAGACAAGUCGGGACUUUUCAG-5' | (SEQ ID NO: 687) |  |
| AT3-1261 Target: | 5'-TGTCGATCTGTTCAGCCCTGAAAAGTC-3' | (SEQ ID NO: 1071) |  |
|  | 5'-UCGAUCUGUUCAGCCCUGAAAAGUCCA-3' | (SEQ ID NO: 2224) |  |
|  | 3'-AGCUAGACAAGUCGGGACUUUUCAGGU-5' | (SEQ ID NO: 688) |  |
| AT3-1263 Target: | 5'-TCGATCTGTTCAGCCCTGAAAAGTCCA-3' | (SEQ ID NO: 1072) |  |
|  | 5'-AUCUGUUCAGCCCUGAAAAGUCCAAAC-3' | (SEQ ID NO: 2225) |  |
|  | 3'-UAGACAAGUCGGGACUUUUCAGGUUUG-5' | (SEQ ID NO: 689) |  |
| AT3-1266 Target: | 5'-ATCTGTTCAGCCCTGAAAAGTCCAAAC-3' | (SEQ ID NO: 1073) |  |
|  | 5'-CUGUUCAGCCCUGAAAAGUCCAAACUC-3' | (SEQ ID NO: 2226) |  |
|  | 3'-GACAAGUCGGGACUUUUCAGGUUUGAG-5' | (SEQ ID NO: 690) |  |
| AT3-1268 Target: | 5'-CTGTTCAGCCCTGAAAAGTCCAAACTC-3' | (SEQ ID NO: 1074) |  |
|  | 5'-GAAAAGUCCAAACUCCCAGGUAUUGUU-3' | (SEQ ID NO: 2227) |  |
|  | 3'-CUUUUCAGGUUUGAGGGUCCAUAACAA-5' | (SEQ ID NO: 691) |  |
| AT3-1280 Target: | 5'-GAAAAGTCCAAACTCCCAGGTATTGTT-3' | (SEQ ID NO: 1075) |  |
|  | 5'-AAAAGUCCAAACUCCCAGGUAUUGUUG-3' | (SEQ ID NO: 2228) |  |
|  | 3'-UUUUCAGGUUUGAGGGUCCAUAACAAC-5' | (SEQ ID NO: 692) |  |
| AT3-1281 Target: | 5'-AAAAGTCCAAACTCCCAGGTATTGTTG-3' | (SEQ ID NO: 1076) |  |
|  | 5'-AAGUCCAAACUCCCAGGUAUUGUUGCA-3' | (SEQ ID NO: 2229) |  |
|  | 3'-UUCAGGUUUGAGGGUCCAUAACAACGU-5' | (SEQ ID NO: 693) |  |
| AT3-1283 Target: | 5'-AAGTCCAAACTCCCAGGTATTGTTGCA-3' | (SEQ ID NO: 1077) |  |
|  | 5'-GUCCAAACUCCCAGGUAUUGUUGCAGA-3' | (SEQ ID NO: 2230) |  |
|  | 3'-CAGGUUUGAGGGUCCAUAACAACGUCU-5' | (SEQ ID NO: 694) |  |
| AT3-1285 Target: | 5'-GTCCAAACTCCCAGGTATTGTTGCAGA-3' | (SEQ ID NO: 1078) |  |
|  | 5'-UCCAAACUCCCAGGUAUUGUUGCAGAA-3' | (SEQ ID NO: 2231) |  |
|  | 3'-AGGUUUGAGGGUCCAUAACAACGUCUU-5' | (SEQ ID NO: 695) |  |
| AT3-1286 Target: | 5'-TCCAAACTCCCAGGTATTGTTGCAGAA-3' | (SEQ ID NO: 1079) |  |
|  | 5'-CCAAACUCCCAGGUAUUGUUGCAGAAG-3' | (SEQ ID NO: 2232) |  |
|  | 3'-GGUUUGAGGGUCCAUAACAACGUCUUC-5' | (SEQ ID NO: 696) |  |
| AT3-1287 Target: | 5'-CCAAACTCCCAGGTATTGTTGCAGAAG-3' | (SEQ ID NO: 1080) |  |
|  | 5'-CAAACUCCCAGGUAUUGUUGCAGAAGG-3' | (SEQ ID NO: 2233) |  |
|  | 3'-GUUUGAGGGUCCAUAACAACGUCUUCC-5' | (SEQ ID NO: 697) |  |
| AT3-1288 Target: | 5'-CAAACTCCCAGGTATTGTTGCAGAAGG-3' | (SEQ ID NO: 1081) |  |
|  | 5'-UCCAUAAGGCAUUUCUUGAGGUAAAUG-3' | (SEQ ID NO: 2234) |  |
|  | 3'-AGGUAUUCCGUAAAGAACUCCAUUUAC-5' | (SEQ ID NO: 698) |  |
| AT3-1344 Target: | 5'-TCCATAAGGCATTTCTTGAGGTAAATG-3' | (SEQ ID NO: 1082) |  |
|  | 5'-CCAUAAGGCAUUUCUUGAGGUAAAUGA-3' | (SEQ ID NO: 2235) |  |
|  | 3'-GGUAUUCCGUAAAGAACUCCAUUUACU-5' | (SEQ ID NO: 699) |  |
| AT3-1345 Target: | 5'-CCATAAGGCATTTCTTGAGGTAAATGA-3' | (SEQ ID NO: 1083) |  |
|  | 5'-CAUAAGGCAUUUCUUGAGGUAAAUGAA-3' | (SEQ ID NO: 2236) |  |
|  | 3'-GUAUUCCGUAAAGAACUCCAUUUACUU-5' | (SEQ ID NO: 700) |  |
| AT3-1346 Target: | 5'-CATAAGGCATTTCTTGAGGTAAATGAA-3' | (SEQ ID NO: 1084) |  |
|  | 5'-AUAAGGCAUUUCUUGAGGUAAAUGAAG-3' | (SEQ ID NO: 2237) |  |
|  | 3'-UAUUCCGUAAAGAACUCCAUUUACUUC-5' | (SEQ ID NO: 701) |  |
| AT3-1347 Target: | 5'-ATAAGGCATTTCTTGAGGTAAATGAAG-3' | (SEQ ID NO: 1085) |  |

TABLE 5-continued

Selected Human Anti-AT3 "Blunt/Blunt" DsiRNAs

|  |  |  |  |
|---|---|---|---|
| AT3-1348 | Target: | 5'-UAAGGCAUUUCUUGAGGUAAAUGAAGA-3'<br>3'-AUUCCGUAAAGAACUCCAUUUACUUCU-5'<br>5'-TAAGGCATTTCTTGAGGTAAATGAAGA-3' | (SEQ ID NO: 2238)<br>(SEQ ID NO: 702)<br>(SEQ ID NO: 1086) |
| AT3-1349 | Target: | 5'-AAGGCAUUUCUUGAGGUAAAUGAAGAA-3'<br>3'-UUCCGUAAAGAACUCCAUUUACUUCUU-5'<br>5'-AAGGCATTTCTTGAGGTAAATGAAGAA-3' | (SEQ ID NO: 2239)<br>(SEQ ID NO: 703)<br>(SEQ ID NO: 1087) |
| AT3-1350 | Target: | 5'-AGGCAUUUCUUGAGGUAAAUGAAGAAG-3'<br>3'-UCCGUAAAGAACUCCAUUUACUUCUUC-5'<br>5'-AGGCATTTCTTGAGGTAAATGAAGAAG-3' | (SEQ ID NO: 2240)<br>(SEQ ID NO: 704)<br>(SEQ ID NO: 1088) |
| AT3-1351 | Target: | 5'-GGCAUUUCUUGAGGUAAAUGAAGAAGG-3'<br>3'-CCGUAAAGAACUCCAUUUACUUCUUCC-5'<br>5'-GGCATTTCTTGAGGTAAATGAAGAAGG-3' | (SEQ ID NO: 2241)<br>(SEQ ID NO: 705)<br>(SEQ ID NO: 1089) |
| AT3-1358 | Target: | 5'-CUUGAGGUAAAUGAAGAAGGCAGUGAA-3'<br>3'-GAACUCCAUUUACUUCUUCCGUCACUU-5'<br>5'-CTTGAGGTAAATGAAGAAGGCAGTGAA-3' | (SEQ ID NO: 2242)<br>(SEQ ID NO: 706)<br>(SEQ ID NO: 1090) |
| AT3-1359 | Target: | 5'-UUGAGGUAAAUGAAGAAGGCAGUGAAG-3'<br>3'-AACUCCAUUUACUUCUUCCGUCACUUC-5'<br>5'-TTGAGGTAAATGAAGAAGGCAGTGAAG-3' | (SEQ ID NO: 2243)<br>(SEQ ID NO: 707)<br>(SEQ ID NO: 1091) |
| AT3-1360 | Target: | 5'-UGAGGUAAAUGAAGAAGGCAGUGAAGC-3'<br>3'-ACUCCAUUUACUUCUUCCGUCACUUCG-5'<br>5'-TGAGGTAAATGAAGAAGGCAGTGAAGC-3' | (SEQ ID NO: 2244)<br>(SEQ ID NO: 708)<br>(SEQ ID NO: 1092) |
| AT3-1361 | Target: | 5'-GAGGUAAAUGAAGAAGGCAGUGAAGCA-3'<br>3'-CUCCAUUUACUUCUUCCGUCACUUCGU-5'<br>5'-GAGGTAAATGAAGAAGGCAGTGAAGCA-3' | (SEQ ID NO: 2245)<br>(SEQ ID NO: 709)<br>(SEQ ID NO: 1093) |
| AT3-1362 | Target: | 5'-AGGUAAAUGAAGAAGGCAGUGAAGCAG-3'<br>3'-UCCAUUUACUUCUUCCGUCACUUCGUC-5'<br>5'-AGGTAAATGAAGAAGGCAGTGAAGCAG-3' | (SEQ ID NO: 2246)<br>(SEQ ID NO: 710)<br>(SEQ ID NO: 1094) |
| AT3-1363 | Target: | 5'-GGUAAAUGAAGAAGGCAGUGAAGCAGC-3'<br>3'-CCAUUUACUUCUUCCGUCACUUCGUCG-5'<br>5'-GGTAAATGAAGAAGGCAGTGAAGCAGC-3' | (SEQ ID NO: 2247)<br>(SEQ ID NO: 711)<br>(SEQ ID NO: 1095) |
| AT3-1364 | Target: | 5'-GUAAAUGAAGAAGGCAGUGAAGCAGCU-3'<br>3'-CAUUUACUUCUUCCGUCACUUCGUCGA-5'<br>5'-GTAAATGAAGAAGGCAGTGAAGCAGCT-3' | (SEQ ID NO: 2248)<br>(SEQ ID NO: 712)<br>(SEQ ID NO: 1096) |
| AT3-1369 | Target: | 5'-UGAAGAAGGCAGUGAAGCAGCUGCAAG-3'<br>3'-ACUUCUUCCGUCACUUCGUCGACGUUC-5'<br>5'-TGAAGAAGGCAGTGAAGCAGCTGCAAG-3' | (SEQ ID NO: 2249)<br>(SEQ ID NO: 713)<br>(SEQ ID NO: 1097) |
| AT3-1372 | Target: | 5'-AGAAGGCAGUGAAGCAGCUGCAAGUAC-3'<br>3'-UCUUCCGUCACUUCGUCGACGUUCAUG-5'<br>5'-AGAAGGCAGTGAAGCAGCTGCAAGTAC-3' | (SEQ ID NO: 2250)<br>(SEQ ID NO: 714)<br>(SEQ ID NO: 1098) |
| AT3-1373 | Target: | 5'-GAAGGCAGUGAAGCAGCUGCAAGUACC-3'<br>3'-CUUCCGUCACUUCGUCGACGUUCAUGG-5'<br>5'-GAAGGCAGTGAAGCAGCTGCAAGTACC-3' | (SEQ ID NO: 2251)<br>(SEQ ID NO: 715)<br>(SEQ ID NO: 1099) |
| AT3-1381 | Target: | 5'-UGAAGCAGCUGCAAGUACCGCUGUUGU-3'<br>3'-ACUUCGUCGACGUUCAUGGCGACAACA-5'<br>5'-TGAAGCAGCTGCAAGTACCGCTGTTGT-3' | (SEQ ID NO: 2252)<br>(SEQ ID NO: 716)<br>(SEQ ID NO: 1100) |
| AT3-1452 | Target: | 5'-CCAACAGGCCUUUCCUGGUUUUUAUAA-3'<br>3'-GGUUGUCCGGAAAGGACCAAAAAUAUU-5'<br>5'-CCAACAGGCCTTTCCTGGTTTTTATAA-3' | (SEQ ID NO: 2253)<br>(SEQ ID NO: 717)<br>(SEQ ID NO: 1101) |
| AT3-1453 | Target: | 5'-CAACAGGCCUUUCCUGGUUUUUAUAAG-3'<br>3'-GUUGUCCGGAAAGGACCAAAAAUAUUC-5'<br>5'-CAACAGGCCTTTCCTGGTTTTTATAAG-3' | (SEQ ID NO: 2254)<br>(SEQ ID NO: 718)<br>(SEQ ID NO: 1102) |
| AT3-1454 | Target: | 5'-AACAGGCCUUUCCUGGUUUUUAUAAGA-3'<br>3'-UUGUCCGGAAAGGACCAAAAAUAUUCU-5'<br>5'-AACAGGCCTTTCCTGGTTTTTATAAGA-3' | (SEQ ID NO: 2255)<br>(SEQ ID NO: 719)<br>(SEQ ID NO: 1103) |
| AT3-1455 | Target: | 5'-ACAGGCCUUUCCUGGUUUUUAUAAGAG-3'<br>3'-UGUCCGGAAAGGACCAAAAAUAUUCUC-5'<br>5'-ACAGGCCTTTCCTGGTTTTTATAAGAG-3' | (SEQ ID NO: 2256)<br>(SEQ ID NO: 720)<br>(SEQ ID NO: 1104) |

TABLE 5-continued

Selected Human Anti-AT3 "Blunt/Blunt" DsiRNAs

|  |  |  |  |
|---|---|---|---|
| AT3-1456 | Target: | 5'-CAGGCCUUUCCUGGUUUUUAUAAGAGA-3'<br>3'-GUCCGGAAAGGACCAAAAAUAUUCUCU-5'<br>5'-CAGGCCTTTCCTGGTTTTTATAAGAGA-3' | (SEQ ID NO: 2257)<br>(SEQ ID NO: 721)<br>(SEQ ID NO: 1105) |
| AT3-1457 | Target: | 5'-AGGCCUUUCCUGGUUUUUAUAAGAGAA-3'<br>3'-UCCGGAAAGGACCAAAAAUAUUCUCUU-5'<br>5'-AGGCCTTTCCTGGTTTTTATAAGAGAA-3' | (SEQ ID NO: 2258)<br>(SEQ ID NO: 722)<br>(SEQ ID NO: 1106) |
| AT3-1459 | Target: | 5'-GCCUUUCCUGGUUUUUAUAAGAGAAGU-3'<br>3'-CGGAAAGGACCAAAAAUAUUCUCUUCA-5'<br>5'-GCCTTTCCTGGTTTTTATAAGAGAAGT-3' | (SEQ ID NO: 2259)<br>(SEQ ID NO: 723)<br>(SEQ ID NO: 1107) |
| AT3-1460 | Target: | 5'-CCUUUCCUGGUUUUUAUAAGAGAAGUU-3'<br>3'-GGAAAGGACCAAAAAUAUUCUCUUCAA-5'<br>5'-CCTTTCCTGGTTTTTATAAGAGAAGTT-3' | (SEQ ID NO: 2260)<br>(SEQ ID NO: 724)<br>(SEQ ID NO: 1108) |
| AT3-1461 | Target: | 5'-CUUUCCUGGUUUUUAUAAGAGAAGUUC-3'<br>3'-GAAAGGACCAAAAAUAUUCUCUUCAAG-5'<br>5'-CTTTCCTGGTTTTTATAAGAGAAGTTC-3' | (SEQ ID NO: 2261)<br>(SEQ ID NO: 725)<br>(SEQ ID NO: 1109) |
| AT3-1462 | Target: | 5'-UUUCCUGGUUUUUAUAAGAGAAGUUCC-3'<br>3'-AAAGGACCAAAAAUAUUCUCUUCAAGG-5'<br>5'-TTTCCTGGTTTTTATAAGAGAAGTTCC-3' | (SEQ ID NO: 2262)<br>(SEQ ID NO: 726)<br>(SEQ ID NO: 1110) |
| AT3-1463 | Target: | 5'-UUCCUGGUUUUUAUAAGAGAAGUUCCU-3'<br>3'-AAGGACCAAAAAUAUUCUCUUCAAGGA-5'<br>5'-TTCCTGGTTTTTATAAGAGAAGTTCCT-3' | (SEQ ID NO: 2263)<br>(SEQ ID NO: 727)<br>(SEQ ID NO: 1111) |
| AT3-1464 | Target: | 5'-UCCUGGUUUUUAUAAGAGAAGUUCCUC-3'<br>3'-AGGACCAAAAAUAUUCUCUUCAAGGAG-5'<br>5'-TCCTGGTTTTTATAAGAGAAGTTCCTC-3' | (SEQ ID NO: 2264)<br>(SEQ ID NO: 728)<br>(SEQ ID NO: 1112) |
| AT3-1465 | Target: | 5'-CCUGGUUUUUAUAAGAGAAGUUCCUCU-3'<br>3'-GGACCAAAAAUAUUCUCUUCAAGGAGA-5'<br>5'-CCTGGTTTTTATAAGAGAAGTTCCTCT-3' | (SEQ ID NO: 2265)<br>(SEQ ID NO: 729)<br>(SEQ ID NO: 1113) |
| AT3-1466 | Target: | 5'-CUGGUUUUUAUAAGAGAAGUUCCUCUG-3'<br>3'-GACCAAAAAUAUUCUCUUCAAGGAGAC-5'<br>5'-CTGGTTTTTATAAGAGAAGTTCCTCTG-3' | (SEQ ID NO: 2266)<br>(SEQ ID NO: 730)<br>(SEQ ID NO: 1114) |
| AT3-1467 | Target: | 5'-UGGUUUUUAUAAGAGAAGUUCCUCUGA-3'<br>3'-ACCAAAAAUAUUCUCUUCAAGGAGACU-5'<br>5'-TGGTTTTTATAAGAGAAGTTCCTCTGA-3' | (SEQ ID NO: 2267)<br>(SEQ ID NO: 731)<br>(SEQ ID NO: 1115) |
| AT3-1468 | Target: | 5'-GGUUUUUAUAAGAGAAGUUCCUCUGAA-3'<br>3'-CCAAAAAUAUUCUCUUCAAGGAGACUU-5'<br>5'-GGTTTTTATAAGAGAAGTTCCTCTGAA-3' | (SEQ ID NO: 2268)<br>(SEQ ID NO: 732)<br>(SEQ ID NO: 1116) |
| AT3-1469 | Target: | 5'-GUUUUUAUAAGAGAAGUUCCUCUGAAC-3'<br>3'-CAAAAAUAUUCUCUUCAAGGAGACUUG-5'<br>5'-GTTTTTATAAGAGAAGTTCCTCTGAAC-3' | (SEQ ID NO: 2269)<br>(SEQ ID NO: 733)<br>(SEQ ID NO: 1117) |
| AT3-1470 | Target: | 5'-UUUUUAUAAGAGAAGUUCCUCUGAACA-3'<br>3'-AAAAAUAUUCUCUUCAAGGAGACUUGU-5'<br>5'-TTTTTATAAGAGAAGTTCCTCTGAACA-3' | (SEQ ID NO: 2270)<br>(SEQ ID NO: 734)<br>(SEQ ID NO: 1118) |
| AT3-1471 | Target: | 5'-UUUUAUAAGAGAAGUUCCUCUGAACAC-3'<br>3'-AAAAUAUUCUCUUCAAGGAGACUUGUG-5'<br>5'-TTTTATAAGAGAAGTTCCTCTGAACAC-3' | (SEQ ID NO: 2271)<br>(SEQ ID NO: 735)<br>(SEQ ID NO: 1119) |
| AT3-1472 | Target: | 5'-UUUAUAAGAGAAGUUCCUCUGAACACU-3'<br>3'-AAAUAUUCUCUUCAAGGAGACUUGUGA-5'<br>5'-TTTATAAGAGAAGTTCCTCTGAACACT-3' | (SEQ ID NO: 2272)<br>(SEQ ID NO: 736)<br>(SEQ ID NO: 1120) |
| AT3-1473 | Target: | 5'-UUAUAAGAGAAGUUCCUCUGAACACUA-3'<br>3'-AAUAUUCUCUUCAAGGAGACUUGUGAU-5'<br>5'-TTATAAGAGAAGTTCCTCTGAACACTA-3' | (SEQ ID NO: 2273)<br>(SEQ ID NO: 737)<br>(SEQ ID NO: 1121) |
| AT3-1474 | Target: | 5'-UAUAAGAGAAGUUCCUCUGAACACUAU-3'<br>3'-AUAUUCUCUUCAAGGAGACUUGUGAUA-5'<br>5'-TATAAGAGAAGTTCCTCTGAACACTAT-3' | (SEQ ID NO: 2274)<br>(SEQ ID NO: 738)<br>(SEQ ID NO: 1122) |
| AT3-1475 | Target: | 5'-AUAAGAGAAGUUCCUCUGAACACUAUU-3'<br>3'-UAUUCUCUUCAAGGAGACUUGUGAUAA-5'<br>5'-ATAAGAGAAGTTCCTCTGAACACTATT-3' | (SEQ ID NO: 2275)<br>(SEQ ID NO: 739)<br>(SEQ ID NO: 1123) |

TABLE 5-continued

Selected Human Anti-AT3 "Blunt/Blunt" DsiRNAs

```
                  5'-UAAGAGAAGUUCCUCUGAACACUAUUA-3'    (SEQ ID NO: 2276)
                  3'-AUUCUCUUCAAGGAGACUUGUGAUAAU-5'    (SEQ ID NO: 740)
AT3-1476 Target:  5'-TAAGAGAAGTTCCTCTGAACACTATTA-3'    (SEQ ID NO: 1124)

5'-AAGAGAAGUUCCUCUGAACACUAUUAU-3'    (SEQ ID NO: 2277)
                  3'-UUCUCUUCAAGGAGACUUGUGAUAAUA-5'    (SEQ ID NO: 741)
AT3-1477 Target:  5'-AAGAGAAGTTCCTCTGAACACTATTAT-3'    (SEQ ID NO: 1125)

5'-AGAGAAGUUCCUCUGAACACUAUUAUC-3'    (SEQ ID NO: 2278)
                  3'-UCUCUUCAAGGAGACUUGUGAUAAUAG-5'    (SEQ ID NO: 742)
AT3-1478 Target:  5'-AGAGAAGTTCCTCTGAACACTATTATC-3'    (SEQ ID NO: 1126)

5'-GAGAAGUUCCUCUGAACACUAUUAUCU-3'    (SEQ ID NO: 2279)
                  3'-CUCUUCAAGGAGACUUGUGAUAAUAGA-5'    (SEQ ID NO: 743)
AT3-1479 Target:  5'-GAGAAGTTCCTCTGAACACTATTATCT-3'    (SEQ ID NO: 1127)

5'-AGAAGUUCCUCUGAACACUAUUAUCUU-3'    (SEQ ID NO: 2280)
                  3'-UCUUCAAGGAGACUUGUGAUAAUAGAA-5'    (SEQ ID NO: 744)
AT3-1480 Target:  5'-AGAAGTTCCTCTGAACACTATTATCTT-3'    (SEQ ID NO: 1128)

5'-GAAGUUCCUCUGAACACUAUUAUCUUC-3'    (SEQ ID NO: 2281)
                  3'-CUUCAAGGAGACUUGUGAUAAUAGAAG-5'    (SEQ ID NO: 745)
AT3-1481 Target:  5'-GAAGTTCCTCTGAACACTATTATCTTC-3'    (SEQ ID NO: 1129)

5'-AAGUUCCUCUGAACACUAUUAUCUUCA-3'    (SEQ ID NO: 2282)
                  3'-UUCAAGGAGACUUGUGAUAAUAGAAGU-5'    (SEQ ID NO: 746)
AT3-1482 Target:  5'-AAGTTCCTCTGAACACTATTATCTTCA-3'    (SEQ ID NO: 1130)

5'-AGUUCCUCUGAACACUAUUAUCUUCAU-3'    (SEQ ID NO: 2283)
                  3'-UCAAGGAGACUUGUGAUAAUAGAAGUA-5'    (SEQ ID NO: 747)
AT3-1483 Target:  5'-AGTTCCTCTGAACACTATTATCTTCAT-3'    (SEQ ID NO: 1131)

5'-GUUCCUCUGAACACUAUUAUCUUCAUG-3'    (SEQ ID NO: 2284)
                  3'-CAAGGAGACUUGUGAUAAUAGAAGUAC-5'    (SEQ ID NO: 748)
AT3-1484 Target:  5'-GTTCCTCTGAACACTATTATCTTCATG-3'    (SEQ ID NO: 1132)

5'-UUCCUCUGAACACUAUUAUCUUCAUGG-3'    (SEQ ID NO: 2285)
                  3'-AAGGAGACUUGUGAUAAUAGAAGUACC-5'    (SEQ ID NO: 749)
AT3-1485 Target:  5'-TTCCTCTGAACACTATTATCTTCATGG-3'    (SEQ ID NO: 1133)

5'-UCCUCUGAACACUAUUAUCUUCAUGGG-3'    (SEQ ID NO: 2286)
                  3'-AGGAGACUUGUGAUAAUAGAAGUACCC-5'    (SEQ ID NO: 750)
AT3-1486 Target:  5'-TCCTCTGAACACTATTATCTTCATGGG-3'    (SEQ ID NO: 1134)

5'-CUCUGAACACUAUUAUCUUCAUGGGCA-3'    (SEQ ID NO: 2287)
                  3'-GAGACUUGUGAUAAUAGAAGUACCCGU-5'    (SEQ ID NO: 751)
AT3-1488 Target:  5'-CTCTGAACACTATTATCTTCATGGGCA-3'    (SEQ ID NO: 1135)

5'-AACACUAUUAUCUUCAUGGGCAGAGUA-3'    (SEQ ID NO: 2288)
                  3'-UUGUGAUAAUAGAAGUACCCGUCUCAU-5'    (SEQ ID NO: 752)
AT3-1493 Target:  5'-AACACTATTATCTTCATGGGCAGAGTA-3'    (SEQ ID NO: 1136)

5'-ACAGAAGUAAAAAUAAAUACAAACUAC-3'    (SEQ ID NO: 2289)
                  3'-UGUCUUCAUUUUUAUUUAUGUUUGAUG-5'    (SEQ ID NO: 753)
AT3-1584 Target:  5'-ACAGAAGTAAAAATAAATACAAACTAC-3'    (SEQ ID NO: 1137)

5'-CAGAAGUAAAAAUAAAUACAAACUACU-3'    (SEQ ID NO: 2290)
                  3'-GUCUUCAUUUUUAUUUAUGUUUGAUGA-5'    (SEQ ID NO: 754)
AT3-1585 Target:  5'-CAGAAGTAAAAATAAATACAAACTACT-3'    (SEQ ID NO: 1138)

5'-GUGGUGAGAUAUAAGACAUAAUCAGAA-3'    (SEQ ID NO: 2291)
                  3'-CACCACUCUAUAUUCUGUAUUAGUCUU-5'    (SEQ ID NO: 755)
AT3-m78 Target:   5'-GTGGTGAGATATAAGACATAATCAGAA-3'    (SEQ ID NO: 1139)

5'-CAAGCAGCUGAUGGAGGUUUUUAAAUU-3'    (SEQ ID NO: 2292)
                  3'-GUUCGUCGACUACCUCCAAAAAUUUAA-5'    (SEQ ID NO: 756)
AT3-m634 Target:  5'-CAAGCAGCTGATGGAGGTTTTTAAATT-3'    (SEQ ID NO: 1140)

5'-UGAUGGAGGUUUUUAAAUUUGAUACCA-3'    (SEQ ID NO: 2293)
                  3'-ACUACCUCCAAAAAUUUAAACUAUGGU-5'    (SEQ ID NO: 757)
AT3-m642 Target:  5'-TGATGGAGGTTTTTAAATTTGATACCA-3'    (SEQ ID NO: 1141)

5'-AGGGAAGUUGCACUGAACACUAUUAUA-3'    (SEQ ID NO: 2294)
                  3'-UCCCUUCAACGUGACUUGUGAUAAUAU-5'    (SEQ ID NO: 758)
AT3-m1574 Target: 5'-AGGGAAGTTGCACTGAACACTATTATA-3'    (SEQ ID NO: 1142)
```

TABLE 5-continued

Selected Human Anti-AT3 "Blunt/Blunt" DsiRNAs

| | | |
|---|---|---|
| | 5'-GAAGUUGCACUGAACACUAUUAUAUUC-3' | (SEQ ID NO: 2295) |
| | 3'-CUUCAACGUGACUUGUGAUAAUAUAAG-5' | (SEQ ID NO: 759) |
| AT3-m1577 Target: | 5'-GAAGTTGCACTGAACACTATTATATTC-3' | (SEQ ID NO: 1143) |
| | 5'-AGUUGCACUGAACACUAUUAUAUUCAU-3' | (SEQ ID NO: 2296) |
| | 3'-UCAACGUGACUUGUGAUAAUAUAAGUA-5' | (SEQ ID NO: 760) |
| AT3-m1579 Target: | 5'-AGTTGCACTGAACACTATTATATTCAT-3' | (SEQ ID NO: 1144) |
| | 5'-UACUUUGGUGUUUGUGAAUAGAAGUAA-3' | (SEQ ID NO: 2297) |
| | 3'-AUGAAACCACAAACACUUAUCUUCAUU-5' | (SEQ ID NO: 761) |
| AT3-m1664 Target: | 5'-TACTTTGGTGTTTGTGAATAGAAGTAA-3' | (SEQ ID NO: 1145) |
| | 5'-UUGGUGUUUGUGAAUAGAAGUAAAAAU-3' | (SEQ ID NO: 2298) |
| | 3'-AACCACAAACACUUAUCUUCAUUUUUA-5' | (SEQ ID NO: 762) |
| AT3-m1668 Target: | 5'-TTGGTGTTTGTGAATAGAAGTAAAAAT-3' | (SEQ ID NO: 1146) |
| | 5'-UGGUGUUUGUGAAUAGAAGUAAAAAUA-3' | (SEQ ID NO: 2299) |
| | 3'-ACCACAAACACUUAUCUUCAUUUUUAU-5' | (SEQ ID NO: 763) |
| AT3-m1669 Target: | 5'-TGGTGTTTGTGAATAGAAGTAAAAATA-3' | (SEQ ID NO: 1147) |
| | 5'-GGUGUUUGUGAAUAGAAGUAAAAAUAA-3' | (SEQ ID NO: 2300) |
| | 3'-CCACAAACACUUAUCUUCAUUUUUAUU-5' | (SEQ ID NO: 764) |
| AT3-m1670 Target: | 5'-GGTGTTTGTGAATAGAAGTAAAAATAA-3' | (SEQ ID NO: 1148) |
| | 5'-GUGUUUGUGAAUAGAAGUAAAAAUAAA-3' | (SEQ ID NO: 2301) |
| | 3'-CACAAACACUUAUCUUCAUUUUUAUUU-5' | (SEQ ID NO: 765) |
| AT3-m1671 Target: | 5'-GTGTTTGTGAATAGAAGTAAAAATAAA-3' | (SEQ ID NO: 1149) |
| | 5'-UUGUGAAUAGAAGUAAAAAUAAAUACG-3' | (SEQ ID NO: 2302) |
| | 3'-AACACUUAUCUUCAUUUUUAUUUAUGC-5' | (SEQ ID NO: 766) |
| AT3-m1675 Target: | 5'-TTGTGAATAGAAGTAAAAATAAATACG-3' | (SEQ ID NO: 1150) |
| | 5'-ACAAGAGGUAAAUAUAUUACUAUUUCA-3' | (SEQ ID NO: 2303) |
| | 3'-UGUUCUCCAUUUAUAUAAUGAUAAAGU-5' | (SEQ ID NO: 767) |
| AT3-m1949 Target: | 5'-ACAAGAGGTAAATATATTACTATTTCA-3' | (SEQ ID NO: 1151) |
| | 5'-AGAGAAAUGCAUUUUUAUACAAAAAAA-3' | (SEQ ID NO: 2304) |
| | 3'-UCUCUUUACGUAAAAAUAUGUUUUUUU-5' | (SEQ ID NO: 768) |
| AT3-m2166 Target: | 5'-AGAGAAATGCATTTTTATACAAAAAAA-3' | (SEQ ID NO: 1152) |

TABLE 6

DsiRNA Component 19 Nucleotide Target Sequences in AT3 mRNA

| | | |
|---|---|---|
| AT3-142 19 nt Target #1: | 5'-CCAUGUAUUCCAAUGUGAU-3' | (SEQ ID NO: 2305) |
| AT3-142 19 nt Target #2: | 5'-GCCAUGUAUUCCAAUGUGA-3' | (SEQ ID NO: 2689) |
| AT3-142 19 nt Target #3: | 5'-GGCCAUGUAUUCCAAUGUG-3' | (SEQ ID NO: 3073) |
| AT3-143 19 nt Target #1: | 5'-CAUGUAUUCCAAUGUGAUA-3' | (SEQ ID NO: 2306) |
| AT3-143 19 nt Target #2: | 5'-CCAUGUAUUCCAAUGUGAU-3' | (SEQ ID NO: 2690) |
| AT3-143 19 nt Target #3: | 5'-GCCAUGUAUUCCAAUGUGA-3' | (SEQ ID NO: 3074) |
| AT3-144 19 nt Target #1: | 5'-AUGUAUUCCAAUGUGAUAG-3' | (SEQ ID NO: 2307) |
| AT3-144 19 nt Target #2: | 5'-CAUGUAUUCCAAUGUGAUA-3' | (SEQ ID NO: 2691) |
| AT3-144 19 nt Target #3: | 5'-CCAUGUAUUCCAAUGUGAU-3' | (SEQ ID NO: 3075) |
| AT3-145 19 nt Target #1: | 5'-UGUAUUCCAAUGUGAUAGG-3' | (SEQ ID NO: 2308) |
| AT3-145 19 nt Target #2: | 5'-AUGUAUUCCAAUGUGAUAG-3' | (SEQ ID NO: 2692) |
| AT3-145 19 nt Target #3: | 5'-CAUGUAUUCCAAUGUGAUA-3' | (SEQ ID NO: 3076) |
| AT3-146 19 nt Target #1: | 5'-GUAUUCCAAUGUGAUAGGA-3' | (SEQ ID NO: 2309) |
| AT3-146 19 nt Target #2: | 5'-UGUAUUCCAAUGUGAUAGG-3' | (SEQ ID NO: 2693) |
| AT3-146 19 nt Target #3: | 5'-AUGUAUUCCAAUGUGAUAG-3' | (SEQ ID NO: 3077) |

TABLE 6-continued

DsiRNA Component 19 Nucleotide Target Sequences in AT3 mRNA

| | | |
|---|---|---|
| AT3-147 19 nt Target #1: | 5'-UAUUCCAAUGUGAUAGGAA-3' | (SEQ ID NO: 2310) |
| AT3-147 19 nt Target #2: | 5'-GUAUUCCAAUGUGAUAGGA-3' | (SEQ ID NO: 2694) |
| AT3-147 19 nt Target #3: | 5'-UGUAUUCCAAUGUGAUAGG-3' | (SEQ ID NO: 3078) |
| AT3-148 19 nt Target #1: | 5'-AUUCCAAUGUGAUAGGAAC-3' | (SEQ ID NO: 2311) |
| AT3-148 19 nt Target #2: | 5'-UAUUCCAAUGUGAUAGGAA-3' | (SEQ ID NO: 2695) |
| AT3-148 19 nt Target #3: | 5'-GUAUUCCAAUGUGAUAGGA-3' | (SEQ ID NO: 3079) |
| AT3-173 19 nt Target #1: | 5'-CUCUGGAAAAAGGAAGGUU-3' | (SEQ ID NO: 2312) |
| AT3-173 19 nt Target #2: | 5'-CCUCUGGAAAAAGGAAGGU-3' | (SEQ ID NO: 2696) |
| AT3-173 19 nt Target #3: | 5'-ACCUCUGGAAAAAGGAAGG-3' | (SEQ ID NO: 3080) |
| AT3-174 19 nt Target #1: | 5'-UCUGGAAAAAGGAAGGUUU-3' | (SEQ ID NO: 2313) |
| AT3-174 19 nt Target #2: | 5'-CUCUGGAAAAAGGAAGGUU-3' | (SEQ ID NO: 2697) |
| AT3-174 19 nt Target #3: | 5'-CCUCUGGAAAAAGGAAGGU-3' | (SEQ ID NO: 3081) |
| AT3-175 19 nt Target #1: | 5'-CUGGAAAAAGGAAGGUUUA-3' | (SEQ ID NO: 2314) |
| AT3-175 19 nt Target #2: | 5'-UCUGGAAAAAGGAAGGUUU-3' | (SEQ ID NO: 2698) |
| AT3-175 19 nt Target #3: | 5'-CUCUGGAAAAAGGAAGGUU-3' | (SEQ ID NO: 3082) |
| AT3-177 19 nt Target #1: | 5'-GGAAAAAGGAAGGUUUAUC-3' | (SEQ ID NO: 2315) |
| AT3-177 19 nt Target #2: | 5'-UGGAAAAAGGAAGGUUUAU-3' | (SEQ ID NO: 2699) |
| AT3-177 19 nt Target #3: | 5'-CUGGAAAAAGGAAGGUUUA-3' | (SEQ ID NO: 3083) |
| AT3-178 19 nt Target #1: | 5'-GAAAAAGGAAGGUUUAUCU-3' | (SEQ ID NO: 2316) |
| AT3-178 19 nt Target #2: | 5'-GGAAAAAGGAAGGUUUAUC-3' | (SEQ ID NO: 2700) |
| AT3-178 19 nt Target #3: | 5'-UGGAAAAAGGAAGGUUUAU-3' | (SEQ ID NO: 3084) |
| AT3-179 19 nt Target #1: | 5'-AAAAAGGAAGGUUUAUCUU-3' | (SEQ ID NO: 2317) |
| AT3-179 19 nt Target #2: | 5'-GAAAAAGGAAGGUUUAUCU-3' | (SEQ ID NO: 2701) |
| AT3-179 19 nt Target #3: | 5'-GGAAAAAGGAAGGUUUAUC-3' | (SEQ ID NO: 3085) |
| AT3-284 19 nt Target #1: | 5'-UCCCAUGAAUCCCAUGUGC-3' | (SEQ ID NO: 2318) |
| AT3-284 19 nt Target #2: | 5'-UUCCCAUGAAUCCCAUGUG-3' | (SEQ ID NO: 2702) |
| AT3-284 19 nt Target #3: | 5'-AUUCCCAUGAAUCCCAUGU-3' | (SEQ ID NO: 3086) |
| AT3-285 19 nt Target #1: | 5'-CCCAUGAAUCCCAUGUGCA-3' | (SEQ ID NO: 2319) |
| AT3-285 19 nt Target #2: | 5'-UCCCAUGAAUCCCAUGUGC-3' | (SEQ ID NO: 2703) |
| AT3-285 19 nt Target #3: | 5'-UUCCCAUGAAUCCCAUGUG-3' | (SEQ ID NO: 3087) |
| AT3-288 19 nt Target #1: | 5'-AUGAAUCCCAUGUGCAUUU-3' | (SEQ ID NO: 2320) |
| AT3-288 19 nt Target #2: | 5'-CAUGAAUCCCAUGUGCAUU-3' | (SEQ ID NO: 2704) |
| AT3-288 19 nt Target #3: | 5'-CCAUGAAUCCCAUGUGCAU-3' | (SEQ ID NO: 3088) |
| AT3-298 19 nt Target #1: | 5'-UGUGCAUUUACCGCUCCCC-3' | (SEQ ID NO: 2321) |
| AT3-298 19 nt Target #2: | 5'-AUGUGCAUUUACCGCUCCC-3' | (SEQ ID NO: 2705) |
| AT3-298 19 nt Target #3: | 5'-CAUGUGCAUUUACCGCUCC-3' | (SEQ ID NO: 3089) |
| AT3-381 19 nt Target #1: | 5'-GUCUGGGAACUGUCCAAGG-3' | (SEQ ID NO: 2322) |
| AT3-381 19 nt Target #2: | 5'-UGUCUGGGAACUGUCCAAG-3' | (SEQ ID NO: 2706) |
| AT3-381 19 nt Target #3: | 5'-GUGUCUGGGAACUGUCCAA-3' | (SEQ ID NO: 3090) |

TABLE 6-continued

DsiRNA Component 19 Nucleotide Target Sequences in AT3 mRNA

| | | |
|---|---|---|
| AT3-382 19 nt Target #1: | 5'-UCUGGGAACUGUCCAAGGC-3' | (SEQ ID NO: 2323) |
| AT3-382 19 nt Target #2: | 5'-GUCUGGGAACUGUCCAAGG-3' | (SEQ ID NO: 2707) |
| AT3-382 19 nt Target #3: | 5'-UGUCUGGGAACUGUCCAAG-3' | (SEQ ID NO: 3091) |
| AT3-383 19 nt Target #1: | 5'-CUGGGAACUGUCCAAGGCC-3' | (SEQ ID NO: 2324) |
| AT3-383 19 nt Target #2: | 5'-UCUGGGAACUGUCCAAGGC-3' | (SEQ ID NO: 2708) |
| AT3-383 19 nt Target #3: | 5'-GUCUGGGAACUGUCCAAGG-3' | (SEQ ID NO: 3092) |
| AT3-384 19 nt Target #1: | 5'-UGGGAACUGUCCAAGGCCA-3' | (SEQ ID NO: 2325) |
| AT3-384 19 nt Target #2: | 5'-CUGGGAACUGUCCAAGGCC-3' | (SEQ ID NO: 2709) |
| AT3-384 19 nt Target #3: | 5'-UCUGGGAACUGUCCAAGGC-3' | (SEQ ID NO: 3093) |
| AT3-385 19 nt Target #1: | 5'-GGGAACUGUCCAAGGCCAA-3' | (SEQ ID NO: 2326) |
| AT3-385 19 nt Target #2: | 5'-UGGGAACUGUCCAAGGCCA-3' | (SEQ ID NO: 2710) |
| AT3-385 19 nt Target #3: | 5'-CUGGGAACUGUCCAAGGCC-3' | (SEQ ID NO: 3094) |
| AT3-386 19 nt Target #1: | 5'-GGAACUGUCCAAGGCCAAU-3' | (SEQ ID NO: 2327) |
| AT3-386 19 nt Target #2: | 5'-GGGAACUGUCCAAGGCCAA-3' | (SEQ ID NO: 2711) |
| AT3-386 19 nt Target #3: | 5'-UGGGAACUGUCCAAGGCCA-3' | (SEQ ID NO: 3095) |
| AT3-387 19 nt Target #1: | 5'-GAACUGUCCAAGGCCAAUU-3' | (SEQ ID NO: 2328) |
| AT3-387 19 nt Target #2: | 5'-GGAACUGUCCAAGGCCAAU-3' | (SEQ ID NO: 2712) |
| AT3-387 19 nt Target #3: | 5'-GGGAACUGUCCAAGGCCAA-3' | (SEQ ID NO: 3096) |
| AT3-388 19 nt Target #1: | 5'-AACUGUCCAAGGCCAAUUC-3' | (SEQ ID NO: 2329) |
| AT3-388 19 nt Target #2: | 5'-GAACUGUCCAAGGCCAAUU-3' | (SEQ ID NO: 2713) |
| AT3-388 19 nt Target #3: | 5'-GGAACUGUCCAAGGCCAAU-3' | (SEQ ID NO: 3097) |
| AT3-403 19 nt Target #1: | 5'-AUUCCCGCUUUGCUACCAC-3' | (SEQ ID NO: 2330) |
| AT3-403 19 nt Target #2: | 5'-AAUUCCCGCUUUGCUACCA-3' | (SEQ ID NO: 2714) |
| AT3-403 19 nt Target #3: | 5'-CAAUUCCCGCUUUGCUACC-3' | (SEQ ID NO: 3098) |
| AT3-406 19 nt Target #1: | 5'-CCCGCUUUGCUACCACUUU-3' | (SEQ ID NO: 2331) |
| AT3-406 19 nt Target #2: | 5'-UCCCGCUUUGCUACCACUU-3' | (SEQ ID NO: 2715) |
| AT3-406 19 nt Target #3: | 5'-UUCCCGCUUUGCUACCACU-3' | (SEQ ID NO: 3099) |
| AT3-407 19 nt Target #1: | 5'-CCGCUUUGCUACCACUUUC-3' | (SEQ ID NO: 2332) |
| AT3-407 19 nt Target #2: | 5'-CCCGCUUUGCUACCACUUU-3' | (SEQ ID NO: 2716) |
| AT3-407 19 nt Target #3: | 5'-UCCCGCUUUGCUACCACUU-3' | (SEQ ID NO: 3100) |
| AT3-408 19 nt Target #1: | 5'-CGCUUUGCUACCACUUUCU-3' | (SEQ ID NO: 2333) |
| AT3-408 19 nt Target #2: | 5'-CCGCUUUGCUACCACUUUC-3' | (SEQ ID NO: 2717) |
| AT3-408 19 nt Target #3: | 5'-CCCGCUUUGCUACCACUUU-3' | (SEQ ID NO: 3101) |
| AT3-409 19 nt Target #1: | 5'-GCUUUGCUACCACUUUCUA-3' | (SEQ ID NO: 2334) |
| AT3-409 19 nt Target #2: | 5'-CGCUUUGCUACCACUUUCU-3' | (SEQ ID NO: 2718) |
| AT3-409 19 nt Target #3: | 5'-CCGCUUUGCUACCACUUUC-3' | (SEQ ID NO: 3102) |
| AT3-410 19 nt Target #1: | 5'-CUUUGCUACCACUUUCUAU-3' | (SEQ ID NO: 2335) |
| AT3-410 19 nt Target #2: | 5'-GCUUUGCUACCACUUUCUA-3' | (SEQ ID NO: 2719) |
| AT3-410 19 nt Target #3: | 5'-CGCUUUGCUACCACUUUCU-3' | (SEQ ID NO: 3103) |

TABLE 6-continued

DsiRNA Component 19 Nucleotide Target Sequences in AT3 mRNA

| | | |
|---|---|---|
| AT3-411 19 nt Target #1: | 5'-UUUGCUACCACUUUCUAUC-3' | (SEQ ID NO: 2336) |
| AT3-411 19 nt Target #2: | 5'-CUUUGCUACCACUUUCUAU-3' | (SEQ ID NO: 2720) |
| AT3-411 19 nt Target #3: | 5'-GCUUUGCUACCACUUUCUA-3' | (SEQ ID NO: 3104) |
| AT3-412 19 nt Target #1: | 5'-UUGCUACCACUUUCUAUCA-3' | (SEQ ID NO: 2337) |
| AT3-412 19 nt Target #2: | 5'-UUUGCUACCACUUUCUAUC-3' | (SEQ ID NO: 2721) |
| AT3-412 19 nt Target #3: | 5'-CUUUGCUACCACUUUCUAU-3' | (SEQ ID NO: 3105) |
| AT3-413 19 nt Target #1: | 5'-UGCUACCACUUUCUAUCAG-3' | (SEQ ID NO: 2338) |
| AT3-413 19 nt Target #2: | 5'-UUGCUACCACUUUCUAUCA-3' | (SEQ ID NO: 2722) |
| AT3-413 19 nt Target #3: | 5'-UUUGCUACCACUUUCUAUC-3' | (SEQ ID NO: 3106) |
| AT3-414 19 nt Target #1: | 5'-GCUACCACUUUCUAUCAGC-3' | (SEQ ID NO: 2339) |
| AT3-414 19 nt Target #2: | 5'-UGCUACCACUUUCUAUCAG-3' | (SEQ ID NO: 2723) |
| AT3-414 19 nt Target #3: | 5'-UUGCUACCACUUUCUAUCA-3' | (SEQ ID NO: 3107) |
| AT3-433 19 nt Target #1: | 5'-ACCUGGCAGAUUCCAAGAA-3' | (SEQ ID NO: 2340) |
| AT3-433 19 nt Target #2: | 5'-CACCUGGCAGAUUCCAAGA-3' | (SEQ ID NO: 2724) |
| AT3-433 19 nt Target #3: | 5'-GCACCUGGCAGAUUCCAAG-3' | (SEQ ID NO: 3108) |
| AT3-459 19 nt Target #1: | 5'-GAUAACAUUUCCUGUCAC-3' | (SEQ ID NO: 2341) |
| AT3-459 19 nt Target #2: | 5'-UGAUAACAUUUCCUGUCA-3' | (SEQ ID NO: 2725) |
| AT3-459 19 nt Target #3: | 5'-AUGAUAACAUUUCCUGUC-3' | (SEQ ID NO: 3109) |
| AT3-462 19 nt Target #1: | 5'-AACAUUUCCUGUCACCCC-3' | (SEQ ID NO: 2342) |
| AT3-462 19 nt Target #2: | 5'-UAACAUUUCCUGUCACCC-3' | (SEQ ID NO: 2726) |
| AT3-462 19 nt Target #3: | 5'-AUAACAUUUCCUGUCACC-3' | (SEQ ID NO: 3110) |
| AT3-464 19 nt Target #1: | 5'-CAUUUCCUGUCACCCCUG-3' | (SEQ ID NO: 2343) |
| AT3-464 19 nt Target #2: | 5'-ACAUUUCCUGUCACCCCU-3' | (SEQ ID NO: 2727) |
| AT3-464 19 nt Target #3: | 5'-AACAUUUCCUGUCACCCC-3' | (SEQ ID NO: 3111) |
| AT3-495 19 nt Target #1: | 5'-GCUUUUGCUAUGACCAAGC-3' | (SEQ ID NO: 2344) |
| AT3-495 19 nt Target #2: | 5'-GGCUUUUGCUAUGACCAAG-3' | (SEQ ID NO: 2728) |
| AT3-495 19 nt Target #3: | 5'-CGGCUUUUGCUAUGACCAA-3' | (SEQ ID NO: 3112) |
| AT3-496 19 nt Target #1: | 5'-CUUUUGCUAUGACCAAGCU-3' | (SEQ ID NO: 2345) |
| AT3-496 19 nt Target #2: | 5'-GCUUUUGCUAUGACCAAGC-3' | (SEQ ID NO: 2729) |
| AT3-496 19 nt Target #3: | 5'-GGCUUUUGCUAUGACCAAG-3' | (SEQ ID NO: 3113) |
| AT3-497 19 nt Target #1: | 5'-UUUUGCUAUGACCAAGCUG-3' | (SEQ ID NO: 2346) |
| AT3-497 19 nt Target #2: | 5'-CUUUUGCUAUGACCAAGCU-3' | (SEQ ID NO: 2730) |
| AT3-497 19 nt Target #3: | 5'-GCUUUUGCUAUGACCAAGC-3' | (SEQ ID NO: 3114) |
| AT3-498 19 nt Target #1: | 5'-UUUGCUAUGACCAAGCUGG-3' | (SEQ ID NO: 2347) |
| AT3-498 19 nt Target #2: | 5'-UUUUGCUAUGACCAAGCUG-3' | (SEQ ID NO: 2731) |
| AT3-498 19 nt Target #3: | 5'-CUUUUGCUAUGACCAAGCU-3' | (SEQ ID NO: 3115) |
| AT3-499 19 nt Target #1: | 5'-UUGCUAUGACCAAGCUGGG-3' | (SEQ ID NO: 2348) |
| AT3-499 19 nt Target #2: | 5'-UUUGCUAUGACCAAGCUGG-3' | (SEQ ID NO: 2732) |
| AT3-499 19 nt Target #3: | 5'-UUUUGCUAUGACCAAGCUG-3' | (SEQ ID NO: 3116) |

TABLE 6-continued

DsiRNA Component 19 Nucleotide Target Sequences in AT3 mRNA

| | | | |
|---|---|---|---|
| AT3-500 19 nt Target #1: | 5'-UGCUAUGACCAAGCUGGGU-3' | (SEQ ID NO: 2349) |
| AT3-500 19 nt Target #2: | 5'-UUGCUAUGACCAAGCUGGG-3' | (SEQ ID NO: 2733) |
| AT3-500 19 nt Target #3: | 5'-UUUGCUAUGACCAAGCUGG-3' | (SEQ ID NO: 3117) |
| AT3-501 19 nt Target #1: | 5'-GCUAUGACCAAGCUGGGUG-3' | (SEQ ID NO: 2350) |
| AT3-501 19 nt Target #2: | 5'-UGCUAUGACCAAGCUGGGU-3' | (SEQ ID NO: 2734) |
| AT3-501 19 nt Target #3: | 5'-UUGCUAUGACCAAGCUGGG-3' | (SEQ ID NO: 3118) |
| AT3-502 19 nt Target #1: | 5'-CUAUGACCAAGCUGGGUGC-3' | (SEQ ID NO: 2351) |
| AT3-502 19 nt Target #2: | 5'-GCUAUGACCAAGCUGGGUG-3' | (SEQ ID NO: 2735) |
| AT3-502 19 nt Target #3: | 5'-UGCUAUGACCAAGCUGGGU-3' | (SEQ ID NO: 3119) |
| AT3-503 19 nt Target #1: | 5'-UAUGACCAAGCUGGGUGCC-3' | (SEQ ID NO: 2352) |
| AT3-503 19 nt Target #2: | 5'-CUAUGACCAAGCUGGGUGC-3' | (SEQ ID NO: 2736) |
| AT3-503 19 nt Target #3: | 5'-GCUAUGACCAAGCUGGGUG-3' | (SEQ ID NO: 3120) |
| AT3-504 19 nt Target #1: | 5'-AUGACCAAGCUGGGUGCCU-3' | (SEQ ID NO: 2353) |
| AT3-504 19 nt Target #2: | 5'-UAUGACCAAGCUGGGUGCC-3' | (SEQ ID NO: 2737) |
| AT3-504 19 nt Target #3: | 5'-CUAUGACCAAGCUGGGUGC-3' | (SEQ ID NO: 3121) |
| AT3-505 19 nt Target #1: | 5'-UGACCAAGCUGGGUGCCUG-3' | (SEQ ID NO: 2354) |
| AT3-505 19 nt Target #2: | 5'-AUGACCAAGCUGGGUGCCU-3' | (SEQ ID NO: 2738) |
| AT3-505 19 nt Target #3: | 5'-UAUGACCAAGCUGGGUGCC-3' | (SEQ ID NO: 3122) |
| AT3-506 19 nt Target #1: | 5'-GACCAAGCUGGGUGCCUGU-3' | (SEQ ID NO: 2355) |
| AT3-506 19 nt Target #2: | 5'-UGACCAAGCUGGGUGCCUG-3' | (SEQ ID NO: 2739) |
| AT3-506 19 nt Target #3: | 5'-AUGACCAAGCUGGGUGCCU-3' | (SEQ ID NO: 3123) |
| AT3-507 19 nt Target #1: | 5'-ACCAAGCUGGGUGCCUGUA-3' | (SEQ ID NO: 2356) |
| AT3-507 19 nt Target #2: | 5'-GACCAAGCUGGGUGCCUGU-3' | (SEQ ID NO: 2740) |
| AT3-507 19 nt Target #3: | 5'-UGACCAAGCUGGGUGCCUG-3' | (SEQ ID NO: 3124) |
| AT3-508 19 nt Target #1: | 5'-CCAAGCUGGGUGCCUGUAA-3' | (SEQ ID NO: 2357) |
| AT3-508 19 nt Target #2: | 5'-ACCAAGCUGGGUGCCUGUA-3' | (SEQ ID NO: 2741) |
| AT3-508 19 nt Target #3: | 5'-GACCAAGCUGGGUGCCUGU-3' | (SEQ ID NO: 3125) |
| AT3-538 19 nt Target #1: | 5'-AGCAACUGAUGGAGGUAUU-3' | (SEQ ID NO: 2358) |
| AT3-538 19 nt Target #2: | 5'-CAGCAACUGAUGGAGGUAU-3' | (SEQ ID NO: 2742) |
| AT3-538 19 nt Target #3: | 5'-CCAGCAACUGAUGGAGGUA-3' | (SEQ ID NO: 3126) |
| AT3-539 19 nt Target #1: | 5'-GCAACUGAUGGAGGUAUUU-3' | (SEQ ID NO: 2359) |
| AT3-539 19 nt Target #2: | 5'-AGCAACUGAUGGAGGUAUU-3' | (SEQ ID NO: 2743) |
| AT3-539 19 nt Target #3: | 5'-CAGCAACUGAUGGAGGUAU-3' | (SEQ ID NO: 3127) |
| AT3-540 19 nt Target #1: | 5'-CAACUGAUGGAGGUAUUUA-3' | (SEQ ID NO: 2360) |
| AT3-540 19 nt Target #2: | 5'-GCAACUGAUGGAGGUAUUU-3' | (SEQ ID NO: 2744) |
| AT3-540 19 nt Target #3: | 5'-AGCAACUGAUGGAGGUAUU-3' | (SEQ ID NO: 3128) |
| AT3-541 19 nt Target #1: | 5'-AACUGAUGGAGGUAUUUAA-3' | (SEQ ID NO: 2361) |
| AT3-541 19 nt Target #2: | 5'-CAACUGAUGGAGGUAUUUA-3' | (SEQ ID NO: 2745) |
| AT3-541 19 nt Target #3: | 5'-GCAACUGAUGGAGGUAUUU-3' | (SEQ ID NO: 3129) |

TABLE 6-continued

DsiRNA Component 19 Nucleotide Target Sequences in AT3 mRNA

| | | |
|---|---|---|
| AT3-542 19 nt Target #1: | 5'-ACUGAUGGAGGUAUUUAAG-3' | (SEQ ID NO: 2362) |
| AT3-542 19 nt Target #2: | 5'-AACUGAUGGAGGUAUUUAA-3' | (SEQ ID NO: 2746) |
| AT3-542 19 nt Target #3: | 5'-CAACUGAUGGAGGUAUUUA-3' | (SEQ ID NO: 3130) |
| AT3-543 19 nt Target #1: | 5'-CUGAUGGAGGUAUUUAAGU-3' | (SEQ ID NO: 2363) |
| AT3-543 19 nt Target #2: | 5'-ACUGAUGGAGGUAUUUAAG-3' | (SEQ ID NO: 2747) |
| AT3-543 19 nt Target #3: | 5'-AACUGAUGGAGGUAUUUAA-3' | (SEQ ID NO: 3131) |
| AT3-544 19 nt Target #1: | 5'-UGAUGGAGGUAUUUAAGUU-3' | (SEQ ID NO: 2364) |
| AT3-544 19 nt Target #2: | 5'-CUGAUGGAGGUAUUUAAGU-3' | (SEQ ID NO: 2748) |
| AT3-544 19 nt Target #3: | 5'-ACUGAUGGAGGUAUUUAAG-3' | (SEQ ID NO: 3132) |
| AT3-545 19 nt Target #1: | 5'-GAUGGAGGUAUUUAAGUUU-3' | (SEQ ID NO: 2365) |
| AT3-545 19 nt Target #2: | 5'-UGAUGGAGGUAUUUAAGUU-3' | (SEQ ID NO: 2749) |
| AT3-545 19 nt Target #3: | 5'-CUGAUGGAGGUAUUUAAGU-3' | (SEQ ID NO: 3133) |
| AT3-546 19 nt Target #1: | 5'-AUGGAGGUAUUUAAGUUUG-3' | (SEQ ID NO: 2366) |
| AT3-546 19 nt Target #2: | 5'-GAUGGAGGUAUUUAAGUUU-3' | (SEQ ID NO: 2750) |
| AT3-546 19 nt Target #3: | 5'-UGAUGGAGGUAUUUAAGUU-3' | (SEQ ID NO: 3134) |
| AT3-547 19 nt Target #1: | 5'-UGGAGGUAUUUAAGUUUGA-3' | (SEQ ID NO: 2367) |
| AT3-547 19 nt Target #2: | 5'-AUGGAGGUAUUUAAGUUUG-3' | (SEQ ID NO: 2751) |
| AT3-547 19 nt Target #3: | 5'-GAUGGAGGUAUUUAAGUUU-3' | (SEQ ID NO: 3135) |
| AT3-548 19 nt Target #1: | 5'-GGAGGUAUUUAAGUUUGAC-3' | (SEQ ID NO: 2368) |
| AT3-548 19 nt Target #2: | 5'-UGGAGGUAUUUAAGUUUGA-3' | (SEQ ID NO: 2752) |
| AT3-548 19 nt Target #3: | 5'-AUGGAGGUAUUUAAGUUUG-3' | (SEQ ID NO: 3136) |
| AT3-549 19 nt Target #1: | 5'-GAGGUAUUUAAGUUUGACA-3' | (SEQ ID NO: 2369) |
| AT3-549 19 nt Target #2: | 5'-GGAGGUAUUUAAGUUUGAC-3' | (SEQ ID NO: 2753) |
| AT3-549 19 nt Target #3: | 5'-UGGAGGUAUUUAAGUUUGA-3' | (SEQ ID NO: 3137) |
| AT3-550 19 nt Target #1: | 5'-AGGUAUUUAAGUUUGACAC-3' | (SEQ ID NO: 2370) |
| AT3-550 19 nt Target #2: | 5'-GAGGUAUUUAAGUUUGACA-3' | (SEQ ID NO: 2754) |
| AT3-550 19 nt Target #3: | 5'-GGAGGUAUUUAAGUUUGAC-3' | (SEQ ID NO: 3138) |
| AT3-551 19 nt Target #1: | 5'-GGUAUUUAAGUUUGACACC-3' | (SEQ ID NO: 2371) |
| AT3-551 19 nt Target #2: | 5'-AGGUAUUUAAGUUUGACAC-3' | (SEQ ID NO: 2755) |
| AT3-551 19 nt Target #3: | 5'-GAGGUAUUUAAGUUUGACA-3' | (SEQ ID NO: 3139) |
| AT3-552 19 nt Target #1: | 5'-GUAUUUAAGUUUGACACCA-3' | (SEQ ID NO: 2372) |
| AT3-552 19 nt Target #2: | 5'-GGUAUUUAAGUUUGACACC-3' | (SEQ ID NO: 2756) |
| AT3-552 19 nt Target #3: | 5'-AGGUAUUUAAGUUUGACAC-3' | (SEQ ID NO: 3140) |
| AT3-553 19 nt Target #1: | 5'-UAUUUAAGUUUGACACCAU-3' | (SEQ ID NO: 2373) |
| AT3-553 19 nt Target #2: | 5'-GUAUUUAAGUUUGACACCA-3' | (SEQ ID NO: 2757) |
| AT3-553 19 nt Target #3: | 5'-GGUAUUUAAGUUUGACACC-3' | (SEQ ID NO: 3141) |
| AT3-554 19 nt Target #1: | 5'-AUUUAAGUUUGACACCAUA-3' | (SEQ ID NO: 2374) |
| AT3-554 19 nt Target #2: | 5'-UAUUUAAGUUUGACACCAU-3' | (SEQ ID NO: 2758) |
| AT3-554 19 nt Target #3: | 5'-GUAUUUAAGUUUGACACCA-3' | (SEQ ID NO: 3142) |

TABLE 6-continued

DsiRNA Component 19 Nucleotide Target Sequences in AT3 mRNA

| | | |
|---|---|---|
| AT3-555 19 nt Target #1: | 5'-UUUAAGUUUGACACCAUAU-3' | (SEQ ID NO: 2375) |
| AT3-555 19 nt Target #2: | 5'-AUUUAAGUUUGACACCAUA-3' | (SEQ ID NO: 2759) |
| AT3-555 19 nt Target #3: | 5'-UAUUUAAGUUUGACACCAU-3' | (SEQ ID NO: 3143) |
| AT3-556 19 nt Target #1: | 5'-UUAAGUUUGACACCAUAUC-3' | (SEQ ID NO: 2376) |
| AT3-556 19 nt Target #2: | 5'-UUUAAGUUUGACACCAUAU-3' | (SEQ ID NO: 2760) |
| AT3-556 19 nt Target #3: | 5'-AUUUAAGUUUGACACCAUA-3' | (SEQ ID NO: 3144) |
| AT3-557 19 nt Target #1: | 5'-UAAGUUUGACACCAUAUCU-3' | (SEQ ID NO: 2377) |
| AT3-557 19 nt Target #2: | 5'-UUAAGUUUGACACCAUAUC-3' | (SEQ ID NO: 2761) |
| AT3-557 19 nt Target #3: | 5'-UUUAAGUUUGACACCAUAU-3' | (SEQ ID NO: 3145) |
| AT3-558 19 nt Target #1: | 5'-AAGUUUGACACCAUAUCUG-3' | (SEQ ID NO: 2378) |
| AT3-558 19 nt Target #2: | 5'-UAAGUUUGACACCAUAUCU-3' | (SEQ ID NO: 2762) |
| AT3-558 19 nt Target #3: | 5'-UUAAGUUUGACACCAUAUC-3' | (SEQ ID NO: 3146) |
| AT3-559 19 nt Target #1: | 5'-AGUUUGACACCAUAUCUGA-3' | (SEQ ID NO: 2379) |
| AT3-559 19 nt Target #2: | 5'-AAGUUUGACACCAUAUCUG-3' | (SEQ ID NO: 2763) |
| AT3-559 19 nt Target #3: | 5'-UAAGUUUGACACCAUAUCU-3' | (SEQ ID NO: 3147) |
| AT3-560 19 nt Target #1: | 5'-GUUUGACACCAUAUCUGAG-3' | (SEQ ID NO: 2380) |
| AT3-560 19 nt Target #2: | 5'-AGUUUGACACCAUAUCUGA-3' | (SEQ ID NO: 2764) |
| AT3-560 19 nt Target #3: | 5'-AAGUUUGACACCAUAUCUG-3' | (SEQ ID NO: 3148) |
| AT3-561 19 nt Target #1: | 5'-UUUGACACCAUAUCUGAGA-3' | (SEQ ID NO: 2381) |
| AT3-561 19 nt Target #2: | 5'-GUUUGACACCAUAUCUGAG-3' | (SEQ ID NO: 2765) |
| AT3-561 19 nt Target #3: | 5'-AGUUUGACACCAUAUCUGA-3' | (SEQ ID NO: 3149) |
| AT3-562 19 nt Target #1: | 5'-UUGACACCAUAUCUGAGAA-3' | (SEQ ID NO: 2382) |
| AT3-562 19 nt Target #2: | 5'-UUUGACACCAUAUCUGAGA-3' | (SEQ ID NO: 2766) |
| AT3-562 19 nt Target #3: | 5'-GUUUGACACCAUAUCUGAG-3' | (SEQ ID NO: 3150) |
| AT3-563 19 nt Target #1: | 5'-UGACACCAUAUCUGAGAAA-3' | (SEQ ID NO: 2383) |
| AT3-563 19 nt Target #2: | 5'-UUGACACCAUAUCUGAGAA-3' | (SEQ ID NO: 2767) |
| AT3-563 19 nt Target #3: | 5'-UUUGACACCAUAUCUGAGA-3' | (SEQ ID NO: 3151) |
| AT3-564 19 nt Target #1: | 5'-GACACCAUAUCUGAGAAAA-3' | (SEQ ID NO: 2384) |
| AT3-564 19 nt Target #2: | 5'-UGACACCAUAUCUGAGAAA-3' | (SEQ ID NO: 2768) |
| AT3-564 19 nt Target #3: | 5'-UUGACACCAUAUCUGAGAA-3' | (SEQ ID NO: 3152) |
| AT3-565 19 nt Target #1: | 5'-ACACCAUAUCUGAGAAAAC-3' | (SEQ ID NO: 2385) |
| AT3-565 19 nt Target #2: | 5'-GACACCAUAUCUGAGAAAA-3' | (SEQ ID NO: 2769) |
| AT3-565 19 nt Target #3: | 5'-UGACACCAUAUCUGAGAAA-3' | (SEQ ID NO: 3153) |
| AT3-566 19 nt Target #1: | 5'-CACCAUAUCUGAGAAAACA-3' | (SEQ ID NO: 2386) |
| AT3-566 19 nt Target #2: | 5'-ACACCAUAUCUGAGAAAAC-3' | (SEQ ID NO: 2770) |
| AT3-566 19 nt Target #3: | 5'-GACACCAUAUCUGAGAAAA-3' | (SEQ ID NO: 3154) |
| AT3-567 19 nt Target #1: | 5'-ACCAUAUCUGAGAAAACAU-3' | (SEQ ID NO: 2387) |
| AT3-567 19 nt Target #2: | 5'-CACCAUAUCUGAGAAAACA-3' | (SEQ ID NO: 2771) |
| AT3-567 19 nt Target #3: | 5'-ACACCAUAUCUGAGAAAAC-3' | (SEQ ID NO: 3155) |

TABLE 6-continued

DsiRNA Component 19 Nucleotide Target Sequences in AT3 mRNA

| | | |
|---|---|---|
| AT3-568 19 nt Target #1: | 5'-CCAUAUCUGAGAAAACAUC-3' | (SEQ ID NO: 2388) |
| AT3-568 19 nt Target #2: | 5'-ACCAUAUCUGAGAAAACAU-3' | (SEQ ID NO: 2772) |
| AT3-568 19 nt Target #3: | 5'-CACCAUAUCUGAGAAAACA-3' | (SEQ ID NO: 3156) |
| AT3-569 19 nt Target #1: | 5'-CAUAUCUGAGAAAACAUCU-3' | (SEQ ID NO: 2389) |
| AT3-569 19 nt Target #2: | 5'-CCAUAUCUGAGAAAACAUC-3' | (SEQ ID NO: 2773) |
| AT3-569 19 nt Target #3: | 5'-ACCAUAUCUGAGAAAACAU-3' | (SEQ ID NO: 3157) |
| AT3-570 19 nt Target #1: | 5'-AUAUCUGAGAAAACAUCUG-3' | (SEQ ID NO: 2390) |
| AT3-570 19 nt Target #2: | 5'-CAUAUCUGAGAAAACAUCU-3' | (SEQ ID NO: 2774) |
| AT3-570 19 nt Target #3: | 5'-CCAUAUCUGAGAAAACAUC-3' | (SEQ ID NO: 3158) |
| AT3-571 19 nt Target #1: | 5'-UAUCUGAGAAAACAUCUGA-3' | (SEQ ID NO: 2391) |
| AT3-571 19 nt Target #2: | 5'-AUAUCUGAGAAAACAUCUG-3' | (SEQ ID NO: 2775) |
| AT3-571 19 nt Target #3: | 5'-CAUAUCUGAGAAAACAUCU-3' | (SEQ ID NO: 3159) |
| AT3-574 19 nt Target #1: | 5'-CUGAGAAAACAUCUGAUCA-3' | (SEQ ID NO: 2392) |
| AT3-574 19 nt Target #2: | 5'-UCUGAGAAAACAUCUGAUC-3' | (SEQ ID NO: 2776) |
| AT3-574 19 nt Target #3: | 5'-AUCUGAGAAAACAUCUGAU-3' | (SEQ ID NO: 3160) |
| AT3-575 19 nt Target #1: | 5'-UGAGAAAACAUCUGAUCAG-3' | (SEQ ID NO: 2393) |
| AT3-575 19 nt Target #2: | 5'-CUGAGAAAACAUCUGAUCA-3' | (SEQ ID NO: 2777) |
| AT3-575 19 nt Target #3: | 5'-UCUGAGAAAACAUCUGAUC-3' | (SEQ ID NO: 3161) |
| AT3-576 19 nt Target #1: | 5'-GAGAAAACAUCUGAUCAGA-3' | (SEQ ID NO: 2394) |
| AT3-576 19 nt Target #2: | 5'-UGAGAAAACAUCUGAUCAG-3' | (SEQ ID NO: 2778) |
| AT3-576 19 nt Target #3: | 5'-CUGAGAAAACAUCUGAUCA-3' | (SEQ ID NO: 3162) |
| AT3-577 19 nt Target #1: | 5'-AGAAAACAUCUGAUCAGAU-3' | (SEQ ID NO: 2395) |
| AT3-577 19 nt Target #2: | 5'-GAGAAAACAUCUGAUCAGA-3' | (SEQ ID NO: 2779) |
| AT3-577 19 nt Target #3: | 5'-UGAGAAAACAUCUGAUCAG-3' | (SEQ ID NO: 3163) |
| AT3-589 19 nt Target #1: | 5'-AUCAGAUCCACUUCUUCUU-3' | (SEQ ID NO: 2396) |
| AT3-589 19 nt Target #2: | 5'-GAUCAGAUCCACUUCUUCU-3' | (SEQ ID NO: 2780) |
| AT3-589 19 nt Target #3: | 5'-UGAUCAGAUCCACUUCUUC-3' | (SEQ ID NO: 3164) |
| AT3-591 19 nt Target #1: | 5'-CAGAUCCACUUCUUCUUUG-3' | (SEQ ID NO: 2397) |
| AT3-591 19 nt Target #2: | 5'-UCAGAUCCACUUCUUCUUU-3' | (SEQ ID NO: 2781) |
| AT3-591 19 nt Target #3: | 5'-AUCAGAUCCACUUCUUCUU-3' | (SEQ ID NO: 3165) |
| AT3-592 19 nt Target #1: | 5'-AGAUCCACUUCUUCUUUGC-3' | (SEQ ID NO: 2398) |
| AT3-592 19 nt Target #2: | 5'-CAGAUCCACUUCUUCUUUG-3' | (SEQ ID NO: 2782) |
| AT3-592 19 nt Target #3: | 5'-UCAGAUCCACUUCUUCUUU-3' | (SEQ ID NO: 3166) |
| AT3-593 19 nt Target #1: | 5'-GAUCCACUUCUUCUUUGCC-3' | (SEQ ID NO: 2399) |
| AT3-593 19 nt Target #2: | 5'-AGAUCCACUUCUUCUUUGC-3' | (SEQ ID NO: 2783) |
| AT3-593 19 nt Target #3: | 5'-CAGAUCCACUUCUUCUUUG-3' | (SEQ ID NO: 3167) |
| AT3-594 19 nt Target #1: | 5'-AUCCACUUCUUCUUUGCCA-3' | (SEQ ID NO: 2400) |
| AT3-594 19 nt Target #2: | 5'-GAUCCACUUCUUCUUUGCC-3' | (SEQ ID NO: 2784) |
| AT3-594 19 nt Target #3: | 5'-AGAUCCACUUCUUCUUUGC-3' | (SEQ ID NO: 3168) |

TABLE 6-continued

DsiRNA Component 19 Nucleotide Target Sequences in AT3 mRNA

| | | |
|---|---|---|
| AT3-595 19 nt Target #1: | 5'-UCCACUUCUUCUUUGCCAA-3' | (SEQ ID NO: 2401) |
| AT3-595 19 nt Target #2: | 5'-AUCCACUUCUUCUUUGCCA-3' | (SEQ ID NO: 2785) |
| AT3-595 19 nt Target #3: | 5'-GAUCCACUUCUUCUUUGCC-3' | (SEQ ID NO: 3169) |
| AT3-596 19 nt Target #1: | 5'-CCACUUCUUCUUUGCCAAA-3' | (SEQ ID NO: 2402) |
| AT3-596 19 nt Target #2: | 5'-UCCACUUCUUCUUUGCCAA-3' | (SEQ ID NO: 2786) |
| AT3-596 19 nt Target #3: | 5'-AUCCACUUCUUCUUUGCCA-3' | (SEQ ID NO: 3170) |
| AT3-597 19 nt Target #1: | 5'-CACUUCUUCUUUGCCAAAC-3' | (SEQ ID NO: 2403) |
| AT3-597 19 nt Target #2: | 5'-CCACUUCUUCUUUGCCAAA-3' | (SEQ ID NO: 2787) |
| AT3-597 19 nt Target #3: | 5'-UCCACUUCUUCUUUGCCAA-3' | (SEQ ID NO: 3171) |
| AT3-598 19 nt Target #1: | 5'-ACUUCUUCUUUGCCAAACU-3' | (SEQ ID NO: 2404) |
| AT3-598 19 nt Target #2: | 5'-CACUUCUUCUUUGCCAAAC-3' | (SEQ ID NO: 2788) |
| AT3-598 19 nt Target #3: | 5'-CCACUUCUUCUUUGCCAAA-3' | (SEQ ID NO: 3172) |
| AT3-599 19 nt Target #1: | 5'-CUUCUUCUUUGCCAAACUG-3' | (SEQ ID NO: 2405) |
| AT3-599 19 nt Target #2: | 5'-ACUUCUUCUUUGCCAAACU-3' | (SEQ ID NO: 2789) |
| AT3-599 19 nt Target #3: | 5'-CACUUCUUCUUUGCCAAAC-3' | (SEQ ID NO: 3173) |
| AT3-600 19 nt Target #1: | 5'-UUCUUCUUUGCCAAACUGA-3' | (SEQ ID NO: 2406) |
| AT3-600 19 nt Target #2: | 5'-CUUCUUCUUUGCCAAACUG-3' | (SEQ ID NO: 2790) |
| AT3-600 19 nt Target #3: | 5'-ACUUCUUCUUUGCCAAACU-3' | (SEQ ID NO: 3174) |
| AT3-601 19 nt Target #1: | 5'-UCUUCUUUGCCAAACUGAA-3' | (SEQ ID NO: 2407) |
| AT3-601 19 nt Target #2: | 5'-UUCUUCUUUGCCAAACUGA-3' | (SEQ ID NO: 2791) |
| AT3-601 19 nt Target #3: | 5'-CUUCUUCUUUGCCAAACUG-3' | (SEQ ID NO: 3175) |
| AT3-602 19 nt Target #1: | 5'-CUUCUUUGCCAAACUGAAC-3' | (SEQ ID NO: 2408) |
| AT3-602 19 nt Target #2: | 5'-UCUUCUUUGCCAAACUGAA-3' | (SEQ ID NO: 2792) |
| AT3-602 19 nt Target #3: | 5'-UUCUUCUUUGCCAAACUGA-3' | (SEQ ID NO: 3176) |
| AT3-603 19 nt Target #1: | 5'-UUCUUUGCCAAACUGAACU-3' | (SEQ ID NO: 2409) |
| AT3-603 19 nt Target #2: | 5'-CUUCUUUGCCAAACUGAAC-3' | (SEQ ID NO: 2793) |
| AT3-603 19 nt Target #3: | 5'-UCUUCUUUGCCAAACUGAA-3' | (SEQ ID NO: 3177) |
| AT3-604 19 nt Target #1: | 5'-UCUUUGCCAAACUGAACUG-3' | (SEQ ID NO: 2410) |
| AT3-604 19 nt Target #2: | 5'-UUCUUUGCCAAACUGAACU-3' | (SEQ ID NO: 2794) |
| AT3-604 19 nt Target #3: | 5'-CUUCUUUGCCAAACUGAAC-3' | (SEQ ID NO: 3178) |
| AT3-605 19 nt Target #1: | 5'-CUUUGCCAAACUGAACUGC-3' | (SEQ ID NO: 2411) |
| AT3-605 19 nt Target #2: | 5'-UCUUUGCCAAACUGAACUG-3' | (SEQ ID NO: 2795) |
| AT3-605 19 nt Target #3: | 5'-UUCUUUGCCAAACUGAACU-3' | (SEQ ID NO: 3179) |
| AT3-606 19 nt Target #1: | 5'-UUUGCCAAACUGAACUGCC-3' | (SEQ ID NO: 2412) |
| AT3-606 19 nt Target #2: | 5'-CUUUGCCAAACUGAACUGC-3' | (SEQ ID NO: 2796) |
| AT3-606 19 nt Target #3: | 5'-UCUUUGCCAAACUGAACUG-3' | (SEQ ID NO: 3180) |
| AT3-607 19 nt Target #1: | 5'-UUGCCAAACUGAACUGCCG-3' | (SEQ ID NO: 2413) |
| AT3-607 19 nt Target #2: | 5'-UUUGCCAAACUGAACUGCC-3' | (SEQ ID NO: 2797) |
| AT3-607 19 nt Target #3: | 5'-CUUUGCCAAACUGAACUGC-3' | (SEQ ID NO: 3181) |

TABLE 6-continued

DsiRNA Component 19 Nucleotide Target Sequences in AT3 mRNA

| | | | |
|---|---|---|---|
| AT3-608 19 nt Target #1: | 5'-UGCCAAACUGAACUGCCGA-3' | (SEQ ID NO: 2414) |
| AT3-608 19 nt Target #2: | 5'-UUGCCAAACUGAACUGCCG-3' | (SEQ ID NO: 2798) |
| AT3-608 19 nt Target #3: | 5'-UUUGCCAAACUGAACUGCC-3' | (SEQ ID NO: 3182) |
| AT3-609 19 nt Target #1: | 5'-GCCAAACUGAACUGCCGAC-3' | (SEQ ID NO: 2415) |
| AT3-609 19 nt Target #2: | 5'-UGCCAAACUGAACUGCCGA-3' | (SEQ ID NO: 2799) |
| AT3-609 19 nt Target #3: | 5'-UUGCCAAACUGAACUGCCG-3' | (SEQ ID NO: 3183) |
| AT3-610 19 nt Target #1: | 5'-CCAAACUGAACUGCCGACU-3' | (SEQ ID NO: 2416) |
| AT3-610 19 nt Target #2: | 5'-GCCAAACUGAACUGCCGAC-3' | (SEQ ID NO: 2800) |
| AT3-610 19 nt Target #3: | 5'-UGCCAAACUGAACUGCCGA-3' | (SEQ ID NO: 3184) |
| AT3-611 19 nt Target #1: | 5'-CAAACUGAACUGCCGACUC-3' | (SEQ ID NO: 2417) |
| AT3-611 19 nt Target #2: | 5'-CCAAACUGAACUGCCGACU-3' | (SEQ ID NO: 2801) |
| AT3-611 19 nt Target #3: | 5'-GCCAAACUGAACUGCCGAC-3' | (SEQ ID NO: 3185) |
| AT3-612 19 nt Target #1: | 5'-AAACUGAACUGCCGACUCU-3' | (SEQ ID NO: 2418) |
| AT3-612 19 nt Target #2: | 5'-CAAACUGAACUGCCGACUC-3' | (SEQ ID NO: 2802) |
| AT3-612 19 nt Target #3: | 5'-CCAAACUGAACUGCCGACU-3' | (SEQ ID NO: 3186) |
| AT3-613 19 nt Target #1: | 5'-AACUGAACUGCCGACUCUA-3' | (SEQ ID NO: 2419) |
| AT3-613 19 nt Target #2: | 5'-AAACUGAACUGCCGACUCU-3' | (SEQ ID NO: 2803) |
| AT3-613 19 nt Target #3: | 5'-CAAACUGAACUGCCGACUC-3' | (SEQ ID NO: 3187) |
| AT3-614 19 nt Target #1: | 5'-ACUGAACUGCCGACUCUAU-3' | (SEQ ID NO: 2420) |
| AT3-614 19 nt Target #2: | 5'-AACUGAACUGCCGACUCUA-3' | (SEQ ID NO: 2804) |
| AT3-614 19 nt Target #3: | 5'-AAACUGAACUGCCGACUCU-3' | (SEQ ID NO: 3188) |
| AT3-615 19 nt Target #1: | 5'-CUGAACUGCCGACUCUAUC-3' | (SEQ ID NO: 2421) |
| AT3-615 19 nt Target #2: | 5'-ACUGAACUGCCGACUCUAU-3' | (SEQ ID NO: 2805) |
| AT3-615 19 nt Target #3: | 5'-AACUGAACUGCCGACUCUA-3' | (SEQ ID NO: 3189) |
| AT3-616 19 nt Target #1: | 5'-UGAACUGCCGACUCUAUCG-3' | (SEQ ID NO: 2422) |
| AT3-616 19 nt Target #2: | 5'-CUGAACUGCCGACUCUAUC-3' | (SEQ ID NO: 2806) |
| AT3-616 19 nt Target #3: | 5'-ACUGAACUGCCGACUCUAU-3' | (SEQ ID NO: 3190) |
| AT3-617 19 nt Target #1: | 5'-GAACUGCCGACUCUAUCGA-3' | (SEQ ID NO: 2423) |
| AT3-617 19 nt Target #2: | 5'-UGAACUGCCGACUCUAUCG-3' | (SEQ ID NO: 2807) |
| AT3-617 19 nt Target #3: | 5'-CUGAACUGCCGACUCUAUC-3' | (SEQ ID NO: 3191) |
| AT3-618 19 nt Target #1: | 5'-AACUGCCGACUCUAUCGAA-3' | (SEQ ID NO: 2424) |
| AT3-618 19 nt Target #2: | 5'-GAACUGCCGACUCUAUCGA-3' | (SEQ ID NO: 2808) |
| AT3-618 19 nt Target #3: | 5'-UGAACUGCCGACUCUAUCG-3' | (SEQ ID NO: 3192) |
| AT3-619 19 nt Target #1: | 5'-ACUGCCGACUCUAUCGAAA-3' | (SEQ ID NO: 2425) |
| AT3-619 19 nt Target #2: | 5'-AACUGCCGACUCUAUCGAA-3' | (SEQ ID NO: 2809) |
| AT3-619 19 nt Target #3: | 5'-GAACUGCCGACUCUAUCGA-3' | (SEQ ID NO: 3193) |
| AT3-620 19 nt Target #1: | 5'-CUGCCGACUCUAUCGAAAA-3' | (SEQ ID NO: 2426) |
| AT3-620 19 nt Target #2: | 5'-ACUGCCGACUCUAUCGAAA-3' | (SEQ ID NO: 2810) |
| AT3-620 19 nt Target #3: | 5'-AACUGCCGACUCUAUCGAA-3' | (SEQ ID NO: 3194) |

TABLE 6-continued

DsiRNA Component 19 Nucleotide Target Sequences in AT3 mRNA

| | | |
|---|---|---|
| AT3-621 19 nt Target #1: | 5'-UGCCGACUCUAUCGAAAAG-3' | (SEQ ID NO: 2427) |
| AT3-621 19 nt Target #2: | 5'-CUGCCGACUCUAUCGAAAA-3' | (SEQ ID NO: 2811) |
| AT3-621 19 nt Target #3: | 5'-ACUGCCGACUCUAUCGAAA-3' | (SEQ ID NO: 3195) |
| AT3-622 19 nt Target #1: | 5'-GCCGACUCUAUCGAAAAGC-3' | (SEQ ID NO: 2428) |
| AT3-622 19 nt Target #2: | 5'-UGCCGACUCUAUCGAAAAG-3' | (SEQ ID NO: 2812) |
| AT3-622 19 nt Target #3: | 5'-CUGCCGACUCUAUCGAAAA-3' | (SEQ ID NO: 3196) |
| AT3-623 19 nt Target #1: | 5'-CCGACUCUAUCGAAAAGCC-3' | (SEQ ID NO: 2429) |
| AT3-623 19 nt Target #2: | 5'-GCCGACUCUAUCGAAAAGC-3' | (SEQ ID NO: 2813) |
| AT3-623 19 nt Target #3: | 5'-UGCCGACUCUAUCGAAAAG-3' | (SEQ ID NO: 3197) |
| AT3-624 19 nt Target #1: | 5'-CGACUCUAUCGAAAAGCCA-3' | (SEQ ID NO: 2430) |
| AT3-624 19 nt Target #2: | 5'-CCGACUCUAUCGAAAAGCC-3' | (SEQ ID NO: 2814) |
| AT3-624 19 nt Target #3: | 5'-GCCGACUCUAUCGAAAAGC-3' | (SEQ ID NO: 3198) |
| AT3-625 19 nt Target #1: | 5'-GACUCUAUCGAAAAGCCAA-3' | (SEQ ID NO: 2431) |
| AT3-625 19 nt Target #2: | 5'-CGACUCUAUCGAAAAGCCA-3' | (SEQ ID NO: 2815) |
| AT3-625 19 nt Target #3: | 5'-CCGACUCUAUCGAAAAGCC-3' | (SEQ ID NO: 3199) |
| AT3-626 19 nt Target #1: | 5'-ACUCUAUCGAAAAGCCAAC-3' | (SEQ ID NO: 2432) |
| AT3-626 19 nt Target #2: | 5'-GACUCUAUCGAAAAGCCAA-3' | (SEQ ID NO: 2816) |
| AT3-626 19 nt Target #3: | 5'-CGACUCUAUCGAAAAGCCA-3' | (SEQ ID NO: 3200) |
| AT3-627 19 nt Target #1: | 5'-CUCUAUCGAAAAGCCAACA-3' | (SEQ ID NO: 2433) |
| AT3-627 19 nt Target #2: | 5'-ACUCUAUCGAAAAGCCAAC-3' | (SEQ ID NO: 2817) |
| AT3-627 19 nt Target #3: | 5'-GACUCUAUCGAAAAGCCAA-3' | (SEQ ID NO: 3201) |
| AT3-628 19 nt Target #1: | 5'-UCUAUCGAAAAGCCAACAA-3' | (SEQ ID NO: 2434) |
| AT3-628 19 nt Target #2: | 5'-CUCUAUCGAAAAGCCAACA-3' | (SEQ ID NO: 2818) |
| AT3-628 19 nt Target #3: | 5'-ACUCUAUCGAAAAGCCAAC-3' | (SEQ ID NO: 3202) |
| AT3-635 19 nt Target #1: | 5'-AAAAGCCAACAAAUCCUCC-3' | (SEQ ID NO: 2435) |
| AT3-635 19 nt Target #2: | 5'-GAAAAGCCAACAAAUCCUC-3' | (SEQ ID NO: 2819) |
| AT3-635 19 nt Target #3: | 5'-CGAAAAGCCAACAAAUCCU-3' | (SEQ ID NO: 3203) |
| AT3-636 19 nt Target #1: | 5'-AAAGCCAACAAAUCCUCCA-3' | (SEQ ID NO: 2436) |
| AT3-636 19 nt Target #2: | 5'-AAAAGCCAACAAAUCCUCC-3' | (SEQ ID NO: 2820) |
| AT3-636 19 nt Target #3: | 5'-GAAAAGCCAACAAAUCCUC-3' | (SEQ ID NO: 3204) |
| AT3-639 19 nt Target #1: | 5'-GCCAACAAAUCCUCCAAGU-3' | (SEQ ID NO: 2437) |
| AT3-639 19 nt Target #2: | 5'-AGCCAACAAAUCCUCCAAG-3' | (SEQ ID NO: 2821) |
| AT3-639 19 nt Target #3: | 5'-AAGCCAACAAAUCCUCCAA-3' | (SEQ ID NO: 3205) |
| AT3-640 19 nt Target #1: | 5'-CCAACAAAUCCUCCAAGUU-3' | (SEQ ID NO: 2438) |
| AT3-640 19 nt Target #2: | 5'-GCCAACAAAUCCUCCAAGU-3' | (SEQ ID NO: 2822) |
| AT3-640 19 nt Target #3: | 5'-AGCCAACAAAUCCUCCAAG-3' | (SEQ ID NO: 3206) |
| AT3-641 19 nt Target #1: | 5'-CAACAAAUCCUCCAAGUUA-3' | (SEQ ID NO: 2439) |
| AT3-641 19 nt Target #2: | 5'-CCAACAAAUCCUCCAAGUU-3' | (SEQ ID NO: 2823) |
| AT3-641 19 nt Target #3: | 5'-GCCAACAAAUCCUCCAAGU-3' | (SEQ ID NO: 3207) |

TABLE 6-continued

DsiRNA Component 19 Nucleotide Target Sequences in AT3 mRNA

| | | |
|---|---|---|
| AT3-642 19 nt Target #1: | 5'-AACAAAUCCUCCAAGUUAG-3' | (SEQ ID NO: 2440) |
| AT3-642 19 nt Target #2: | 5'-CAACAAAUCCUCCAAGUUA-3' | (SEQ ID NO: 2824) |
| AT3-642 19 nt Target #3: | 5'-CCAACAAAUCCUCCAAGUU-3' | (SEQ ID NO: 3208) |
| AT3-643 19 nt Target #1: | 5'-ACAAAUCCUCCAAGUUAGU-3' | (SEQ ID NO: 2441) |
| AT3-643 19 nt Target #2: | 5'-AACAAAUCCUCCAAGUUAG-3' | (SEQ ID NO: 2825) |
| AT3-643 19 nt Target #3: | 5'-CAACAAAUCCUCCAAGUUA-3' | (SEQ ID NO: 3209) |
| AT3-644 19 nt Target #1: | 5'-CAAAUCCUCCAAGUUAGUA-3' | (SEQ ID NO: 2442) |
| AT3-644 19 nt Target #2: | 5'-ACAAAUCCUCCAAGUUAGU-3' | (SEQ ID NO: 2826) |
| AT3-644 19 nt Target #3: | 5'-AACAAAUCCUCCAAGUUAG-3' | (SEQ ID NO: 3210) |
| AT3-655 19 nt Target #1: | 5'-AGUUAGUAUCAGCCAAUCG-3' | (SEQ ID NO: 2443) |
| AT3-655 19 nt Target #2: | 5'-AAGUUAGUAUCAGCCAAUC-3' | (SEQ ID NO: 2827) |
| AT3-655 19 nt Target #3: | 5'-CAAGUUAGUAUCAGCCAAU-3' | (SEQ ID NO: 3211) |
| AT3-659 19 nt Target #1: | 5'-AGUAUCAGCCAAUCGCCUU-3' | (SEQ ID NO: 2444) |
| AT3-659 19 nt Target #2: | 5'-UAGUAUCAGCCAAUCGCCU-3' | (SEQ ID NO: 2828) |
| AT3-659 19 nt Target #3: | 5'-UUAGUAUCAGCCAAUCGCC-3' | (SEQ ID NO: 3212) |
| AT3-664 19 nt Target #1: | 5'-CAGCCAAUCGCCUUUUUGG-3' | (SEQ ID NO: 2445) |
| AT3-664 19 nt Target #2: | 5'-UCAGCCAAUCGCCUUUUUG-3' | (SEQ ID NO: 2829) |
| AT3-664 19 nt Target #3: | 5'-AUCAGCCAAUCGCCUUUUU-3' | (SEQ ID NO: 3213) |
| AT3-665 19 nt Target #1: | 5'-AGCCAAUCGCCUUUUUGGA-3' | (SEQ ID NO: 2446) |
| AT3-665 19 nt Target #2: | 5'-CAGCCAAUCGCCUUUUUGG-3' | (SEQ ID NO: 2830) |
| AT3-665 19 nt Target #3: | 5'-UCAGCCAAUCGCCUUUUUG-3' | (SEQ ID NO: 3214) |
| AT3-666 19 nt Target #1: | 5'-GCCAAUCGCCUUUUUGGAG-3' | (SEQ ID NO: 2447) |
| AT3-666 19 nt Target #2: | 5'-AGCCAAUCGCCUUUUUGGA-3' | (SEQ ID NO: 2831) |
| AT3-666 19 nt Target #3: | 5'-CAGCCAAUCGCCUUUUUGG-3' | (SEQ ID NO: 3215) |
| AT3-670 19 nt Target #1: | 5'-AUCGCCUUUUUGGAGACAA-3' | (SEQ ID NO: 2448) |
| AT3-670 19 nt Target #2: | 5'-AAUCGCCUUUUUGGAGACA-3' | (SEQ ID NO: 2832) |
| AT3-670 19 nt Target #3: | 5'-CAAUCGCCUUUUUGGAGAC-3' | (SEQ ID NO: 3216) |
| AT3-672 19 nt Target #1: | 5'-CGCCUUUUUGGAGACAAAU-3' | (SEQ ID NO: 2449) |
| AT3-672 19 nt Target #2: | 5'-UCGCCUUUUUGGAGACAAA-3' | (SEQ ID NO: 2833) |
| AT3-672 19 nt Target #3: | 5'-AUCGCCUUUUUGGAGACAA-3' | (SEQ ID NO: 3217) |
| AT3-673 19 nt Target #1: | 5'-GCCUUUUUGGAGACAAAUC-3' | (SEQ ID NO: 2450) |
| AT3-673 19 nt Target #2: | 5'-CGCCUUUUUGGAGACAAAU-3' | (SEQ ID NO: 2834) |
| AT3-673 19 nt Target #3: | 5'-UCGCCUUUUUGGAGACAAA-3' | (SEQ ID NO: 3218) |
| AT3-674 19 nt Target #1: | 5'-CCUUUUUGGAGACAAAUCC-3' | (SEQ ID NO: 2451) |
| AT3-674 19 nt Target #2: | 5'-GCCUUUUUGGAGACAAAUC-3' | (SEQ ID NO: 2835) |
| AT3-674 19 nt Target #3: | 5'-CGCCUUUUUGGAGACAAAU-3' | (SEQ ID NO: 3219) |
| AT3-675 19 nt Target #1: | 5'-CUUUUUGGAGACAAAUCCC-3' | (SEQ ID NO: 2452) |
| AT3-675 19 nt Target #2: | 5'-CCUUUUUGGAGACAAAUCC-3' | (SEQ ID NO: 2836) |
| AT3-675 19 nt Target #3: | 5'-GCCUUUUUGGAGACAAAUC-3' | (SEQ ID NO: 3220) |

TABLE 6-continued

DsiRNA Component 19 Nucleotide Target Sequences in AT3 mRNA

| | | |
|---|---|---|
| AT3-676 19 nt Target #1: | 5'-UUUUUGGAGACAAAUCCCU-3' | (SEQ ID NO: 2453) |
| AT3-676 19 nt Target #2: | 5'-CUUUUUGGAGACAAAUCCC-3' | (SEQ ID NO: 2837) |
| AT3-676 19 nt Target #3: | 5'-CCUUUUUGGAGACAAAUCC-3' | (SEQ ID NO: 3221) |
| AT3-680 19 nt Target #1: | 5'-UGGAGACAAAUCCCUUACC-3' | (SEQ ID NO: 2454) |
| AT3-680 19 nt Target #2: | 5'-UUGGAGACAAAUCCCUUAC-3' | (SEQ ID NO: 2838) |
| AT3-680 19 nt Target #3: | 5'-UUUGGAGACAAAUCCCUUA-3' | (SEQ ID NO: 3222) |
| AT3-681 19 nt Target #1: | 5'-GGAGACAAAUCCCUUACCU-3' | (SEQ ID NO: 2455) |
| AT3-681 19 nt Target #2: | 5'-UGGAGACAAAUCCCUUACC-3' | (SEQ ID NO: 2839) |
| AT3-681 19 nt Target #3: | 5'-UUGGAGACAAAUCCCUUAC-3' | (SEQ ID NO: 3223) |
| AT3-682 19 nt Target #1: | 5'-GAGACAAAUCCCUUACCUU-3' | (SEQ ID NO: 2456) |
| AT3-682 19 nt Target #2: | 5'-GGAGACAAAUCCCUUACCU-3' | (SEQ ID NO: 2840) |
| AT3-682 19 nt Target #3: | 5'-UGGAGACAAAUCCCUUACC-3' | (SEQ ID NO: 3224) |
| AT3-683 19 nt Target #1: | 5'-AGACAAAUCCCUUACCUUC-3' | (SEQ ID NO: 2457) |
| AT3-683 19 nt Target #2: | 5'-GAGACAAAUCCCUUACCUU-3' | (SEQ ID NO: 2841) |
| AT3-683 19 nt Target #3: | 5'-GGAGACAAAUCCCUUACCU-3' | (SEQ ID NO: 3225) |
| AT3-684 19 nt Target #1: | 5'-GACAAAUCCCUUACCUUCA-3' | (SEQ ID NO: 2458) |
| AT3-684 19 nt Target #2: | 5'-AGACAAAUCCCUUACCUUC-3' | (SEQ ID NO: 2842) |
| AT3-684 19 nt Target #3: | 5'-GAGACAAAUCCCUUACCUU-3' | (SEQ ID NO: 3226) |
| AT3-685 19 nt Target #1: | 5'-ACAAAUCCCUUACCUUCAA-3' | (SEQ ID NO: 2459) |
| AT3-685 19 nt Target #2: | 5'-GACAAAUCCCUUACCUUCA-3' | (SEQ ID NO: 2843) |
| AT3-685 19 nt Target #3: | 5'-AGACAAAUCCCUUACCUUC-3' | (SEQ ID NO: 3227) |
| AT3-687 19 nt Target #1: | 5'-AAAUCCCUUACCUUCAAUG-3' | (SEQ ID NO: 2460) |
| AT3-687 19 nt Target #2: | 5'-CAAAUCCCUUACCUUCAAU-3' | (SEQ ID NO: 2844) |
| AT3-687 19 nt Target #3: | 5'-ACAAAUCCCUUACCUUCAA-3' | (SEQ ID NO: 3228) |
| AT3-688 19 nt Target #1: | 5'-AAUCCCUUACCUUCAAUGA-3' | (SEQ ID NO: 2461) |
| AT3-688 19 nt Target #2: | 5'-AAAUCCCUUACCUUCAAUG-3' | (SEQ ID NO: 2845) |
| AT3-688 19 nt Target #3: | 5'-CAAAUCCCUUACCUUCAAU-3' | (SEQ ID NO: 3229) |
| AT3-689 19 nt Target #1: | 5'-AUCCCUUACCUUCAAUGAG-3' | (SEQ ID NO: 2462) |
| AT3-689 19 nt Target #2: | 5'-AAUCCCUUACCUUCAAUGA-3' | (SEQ ID NO: 2846) |
| AT3-689 19 nt Target #3: | 5'-AAAUCCCUUACCUUCAAUG-3' | (SEQ ID NO: 3230) |
| AT3-696 19 nt Target #1: | 5'-ACCUUCAAUGAGACCUACC-3' | (SEQ ID NO: 2463) |
| AT3-696 19 nt Target #2: | 5'-UACCUUCAAUGAGACCUAC-3' | (SEQ ID NO: 2847) |
| AT3-696 19 nt Target #3: | 5'-UUACCUUCAAUGAGACCUA-3' | (SEQ ID NO: 3231) |
| AT3-700 19 nt Target #1: | 5'-UCAAUGAGACCUACCAGGA-3' | (SEQ ID NO: 2464) |
| AT3-700 19 nt Target #2: | 5'-UUCAAUGAGACCUACCAGG-3' | (SEQ ID NO: 2848) |
| AT3-700 19 nt Target #3: | 5'-CUUCAAUGAGACCUACCAG-3' | (SEQ ID NO: 3232) |
| AT3-701 19 nt Target #1: | 5'-CAAUGAGACCUACCAGGAC-3' | (SEQ ID NO: 2465) |
| AT3-701 19 nt Target #2: | 5'-UCAAUGAGACCUACCAGGA-3' | (SEQ ID NO: 2849) |
| AT3-701 19 nt Target #3: | 5'-UUCAAUGAGACCUACCAGG-3' | (SEQ ID NO: 3233) |

TABLE 6-continued

DsiRNA Component 19 Nucleotide Target Sequences in AT3 mRNA

| | | |
|---|---|---|
| AT3-702 19 nt Target #1: | 5'-AAUGAGACCUACCAGGACA-3' | (SEQ ID NO: 2466) |
| AT3-702 19 nt Target #2: | 5'-CAAUGAGACCUACCAGGAC-3' | (SEQ ID NO: 2850) |
| AT3-702 19 nt Target #3: | 5'-UCAAUGAGACCUACCAGGA-3' | (SEQ ID NO: 3234) |
| AT3-704 19 nt Target #1: | 5'-UGAGACCUACCAGGACAUC-3' | (SEQ ID NO: 2467) |
| AT3-704 19 nt Target #2: | 5'-AUGAGACCUACCAGGACAU-3' | (SEQ ID NO: 2851) |
| AT3-704 19 nt Target #3: | 5'-AAUGAGACCUACCAGGACA-3' | (SEQ ID NO: 3235) |
| AT3-706 19 nt Target #1: | 5'-AGACCUACCAGGACAUCAG-3' | (SEQ ID NO: 2468) |
| AT3-706 19 nt Target #2: | 5'-GAGACCUACCAGGACAUCA-3' | (SEQ ID NO: 2852) |
| AT3-706 19 nt Target #3: | 5'-UGAGACCUACCAGGACAUC-3' | (SEQ ID NO: 3236) |
| AT3-710 19 nt Target #1: | 5'-CUACCAGGACAUCAGUGAG-3' | (SEQ ID NO: 2469) |
| AT3-710 19 nt Target #2: | 5'-CCUACCAGGACAUCAGUGA-3' | (SEQ ID NO: 2853) |
| AT3-710 19 nt Target #3: | 5'-ACCUACCAGGACAUCAGUG-3' | (SEQ ID NO: 3237) |
| AT3-711 19 nt Target #1: | 5'-UACCAGGACAUCAGUGAGU-3' | (SEQ ID NO: 2470) |
| AT3-711 19 nt Target #2: | 5'-CUACCAGGACAUCAGUGAG-3' | (SEQ ID NO: 2854) |
| AT3-711 19 nt Target #3: | 5'-CCUACCAGGACAUCAGUGA-3' | (SEQ ID NO: 3238) |
| AT3-712 19 nt Target #1: | 5'-ACCAGGACAUCAGUGAGUU-3' | (SEQ ID NO: 2471) |
| AT3-712 19 nt Target #2: | 5'-UACCAGGACAUCAGUGAGU-3' | (SEQ ID NO: 2855) |
| AT3-712 19 nt Target #3: | 5'-CUACCAGGACAUCAGUGAG-3' | (SEQ ID NO: 3239) |
| AT3-713 19 nt Target #1: | 5'-CCAGGACAUCAGUGAGUUG-3' | (SEQ ID NO: 2472) |
| AT3-713 19 nt Target #2: | 5'-ACCAGGACAUCAGUGAGUU-3' | (SEQ ID NO: 2856) |
| AT3-713 19 nt Target #3: | 5'-UACCAGGACAUCAGUGAGU-3' | (SEQ ID NO: 3240) |
| AT3-714 19 nt Target #1: | 5'-CAGGACAUCAGUGAGUUGG-3' | (SEQ ID NO: 2473) |
| AT3-714 19 nt Target #2: | 5'-CCAGGACAUCAGUGAGUUG-3' | (SEQ ID NO: 2857) |
| AT3-714 19 nt Target #3: | 5'-ACCAGGACAUCAGUGAGUU-3' | (SEQ ID NO: 3241) |
| AT3-715 19 nt Target #1: | 5'-AGGACAUCAGUGAGUUGGU-3' | (SEQ ID NO: 2474) |
| AT3-715 19 nt Target #2: | 5'-CAGGACAUCAGUGAGUUGG-3' | (SEQ ID NO: 2858) |
| AT3-715 19 nt Target #3: | 5'-CCAGGACAUCAGUGAGUUG-3' | (SEQ ID NO: 3242) |
| AT3-716 19 nt Target #1: | 5'-GGACAUCAGUGAGUUGGUA-3' | (SEQ ID NO: 2475) |
| AT3-716 19 nt Target #2: | 5'-AGGACAUCAGUGAGUUGGU-3' | (SEQ ID NO: 2859) |
| AT3-716 19 nt Target #3: | 5'-CAGGACAUCAGUGAGUUGG-3' | (SEQ ID NO: 3243) |
| AT3-717 19 nt Target #1: | 5'-GACAUCAGUGAGUUGGUAU-3' | (SEQ ID NO: 2476) |
| AT3-717 19 nt Target #2: | 5'-GGACAUCAGUGAGUUGGUA-3' | (SEQ ID NO: 2860) |
| AT3-717 19 nt Target #3: | 5'-AGGACAUCAGUGAGUUGGU-3' | (SEQ ID NO: 3244) |
| AT3-718 19 nt Target #1: | 5'-ACAUCAGUGAGUUGGUAUA-3' | (SEQ ID NO: 2477) |
| AT3-718 19 nt Target #2: | 5'-GACAUCAGUGAGUUGGUAU-3' | (SEQ ID NO: 2861) |
| AT3-718 19 nt Target #3: | 5'-GGACAUCAGUGAGUUGGUA-3' | (SEQ ID NO: 3245) |
| AT3-735 19 nt Target #1: | 5'-UAUGGAGCCAAGCUCCAGC-3' | (SEQ ID NO: 2478) |
| AT3-735 19 nt Target #2: | 5'-AUAUGGAGCCAAGCUCCAG-3' | (SEQ ID NO: 2862) |
| AT3-735 19 nt Target #3: | 5'-UAUAUGGAGCCAAGCUCCA-3' | (SEQ ID NO: 3246) |

TABLE 6-continued

DsiRNA Component 19 Nucleotide Target Sequences in AT3 mRNA

| | | |
|---|---|---|
| AT3-736 19 nt Target #1: | 5'-AUGGAGCCAAGCUCCAGCC-3' | (SEQ ID NO: 2479) |
| AT3-736 19 nt Target #2: | 5'-UAUGGAGCCAAGCUCCAGC-3' | (SEQ ID NO: 2863) |
| AT3-736 19 nt Target #3: | 5'-AUAUGGAGCCAAGCUCCAG-3' | (SEQ ID NO: 3247) |
| AT3-737 19 nt Target #1: | 5'-UGGAGCCAAGCUCCAGCCC-3' | (SEQ ID NO: 2480) |
| AT3-737 19 nt Target #2: | 5'-AUGGAGCCAAGCUCCAGCC-3' | (SEQ ID NO: 2864) |
| AT3-737 19 nt Target #3: | 5'-UAUGGAGCCAAGCUCCAGC-3' | (SEQ ID NO: 3248) |
| AT3-738 19 nt Target #1: | 5'-GGAGCCAAGCUCCAGCCCC-3' | (SEQ ID NO: 2481) |
| AT3-738 19 nt Target #2: | 5'-UGGAGCCAAGCUCCAGCCC-3' | (SEQ ID NO: 2865) |
| AT3-738 19 nt Target #3: | 5'-AUGGAGCCAAGCUCCAGCC-3' | (SEQ ID NO: 3249) |
| AT3-739 19 nt Target #1: | 5'-GAGCCAAGCUCCAGCCCCU-3' | (SEQ ID NO: 2482) |
| AT3-739 19 nt Target #2: | 5'-GGAGCCAAGCUCCAGCCCC-3' | (SEQ ID NO: 2866) |
| AT3-739 19 nt Target #3: | 5'-UGGAGCCAAGCUCCAGCCC-3' | (SEQ ID NO: 3250) |
| AT3-740 19 nt Target #1: | 5'-AGCCAAGCUCCAGCCCCUG-3' | (SEQ ID NO: 2483) |
| AT3-740 19 nt Target #2: | 5'-GAGCCAAGCUCCAGCCCCU-3' | (SEQ ID NO: 2867) |
| AT3-740 19 nt Target #3: | 5'-GGAGCCAAGCUCCAGCCCC-3' | (SEQ ID NO: 3251) |
| AT3-741 19 nt Target #1: | 5'-GCCAAGCUCCAGCCCCUGG-3' | (SEQ ID NO: 2484) |
| AT3-741 19 nt Target #2: | 5'-AGCCAAGCUCCAGCCCCUG-3' | (SEQ ID NO: 2868) |
| AT3-741 19 nt Target #3: | 5'-GAGCCAAGCUCCAGCCCCU-3' | (SEQ ID NO: 3252) |
| AT3-742 19 nt Target #1: | 5'-CCAAGCUCCAGCCCCUGGA-3' | (SEQ ID NO: 2485) |
| AT3-742 19 nt Target #2: | 5'-GCCAAGCUCCAGCCCCUGG-3' | (SEQ ID NO: 2869) |
| AT3-742 19 nt Target #3: | 5'-AGCCAAGCUCCAGCCCCUG-3' | (SEQ ID NO: 3253) |
| AT3-743 19 nt Target #1: | 5'-CAAGCUCCAGCCCCUGGAC-3' | (SEQ ID NO: 2486) |
| AT3-743 19 nt Target #2: | 5'-CCAAGCUCCAGCCCCUGGA-3' | (SEQ ID NO: 2870) |
| AT3-743 19 nt Target #3: | 5'-GCCAAGCUCCAGCCCCUGG-3' | (SEQ ID NO: 3254) |
| AT3-744 19 nt Target #1: | 5'-AAGCUCCAGCCCCUGGACU-3' | (SEQ ID NO: 2487) |
| AT3-744 19 nt Target #2: | 5'-CAAGCUCCAGCCCCUGGAC-3' | (SEQ ID NO: 2871) |
| AT3-744 19 nt Target #3: | 5'-CCAAGCUCCAGCCCCUGGA-3' | (SEQ ID NO: 3255) |
| AT3-745 19 nt Target #1: | 5'-AGCUCCAGCCCCUGGACUU-3' | (SEQ ID NO: 2488) |
| AT3-745 19 nt Target #2: | 5'-AAGCUCCAGCCCCUGGACU-3' | (SEQ ID NO: 2872) |
| AT3-745 19 nt Target #3: | 5'-CAAGCUCCAGCCCCUGGAC-3' | (SEQ ID NO: 3256) |
| AT3-746 19 nt Target #1: | 5'-GCUCCAGCCCCUGGACUUC-3' | (SEQ ID NO: 2489) |
| AT3-746 19 nt Target #2: | 5'-AGCUCCAGCCCCUGGACUU-3' | (SEQ ID NO: 2873) |
| AT3-746 19 nt Target #3: | 5'-AAGCUCCAGCCCCUGGACU-3' | (SEQ ID NO: 3257) |
| AT3-747 19 nt Target #1: | 5'-CUCCAGCCCCUGGACUUCA-3' | (SEQ ID NO: 2490) |
| AT3-747 19 nt Target #2: | 5'-GCUCCAGCCCCUGGACUUC-3' | (SEQ ID NO: 2874) |
| AT3-747 19 nt Target #3: | 5'-AGCUCCAGCCCCUGGACUU-3' | (SEQ ID NO: 3258) |
| AT3-748 19 nt Target #1: | 5'-UCCAGCCCCUGGACUUCAA-3' | (SEQ ID NO: 2491) |
| AT3-748 19 nt Target #2: | 5'-CUCCAGCCCCUGGACUUCA-3' | (SEQ ID NO: 2875) |
| AT3-748 19 nt Target #3: | 5'-GCUCCAGCCCCUGGACUUC-3' | (SEQ ID NO: 3259) |

TABLE 6-continued

DsiRNA Component 19 Nucleotide Target Sequences in AT3 mRNA

| | | |
|---|---|---|
| AT3-749 19 nt Target #1: | 5'-CCAGCCCCUGGACUUCAAG-3' | (SEQ ID NO: 2492) |
| AT3-749 19 nt Target #2: | 5'-UCCAGCCCCUGGACUUCAA-3' | (SEQ ID NO: 2876) |
| AT3-749 19 nt Target #3: | 5'-CUCCAGCCCCUGGACUUCA-3' | (SEQ ID NO: 3260) |
| AT3-750 19 nt Target #1: | 5'-CAGCCCCUGGACUUCAAGG-3' | (SEQ ID NO: 2493) |
| AT3-750 19 nt Target #2: | 5'-CCAGCCCCUGGACUUCAAG-3' | (SEQ ID NO: 2877) |
| AT3-750 19 nt Target #3: | 5'-UCCAGCCCCUGGACUUCAA-3' | (SEQ ID NO: 3261) |
| AT3-751 19 nt Target #1: | 5'-AGCCCCUGGACUUCAAGGA-3' | (SEQ ID NO: 2494) |
| AT3-751 19 nt Target #2: | 5'-CAGCCCCUGGACUUCAAGG-3' | (SEQ ID NO: 2878) |
| AT3-751 19 nt Target #3: | 5'-CCAGCCCCUGGACUUCAAG-3' | (SEQ ID NO: 3262) |
| AT3-752 19 nt Target #1: | 5'-GCCCCUGGACUUCAAGGAA-3' | (SEQ ID NO: 2495) |
| AT3-752 19 nt Target #2: | 5'-AGCCCCUGGACUUCAAGGA-3' | (SEQ ID NO: 2879) |
| AT3-752 19 nt Target #3: | 5'-CAGCCCCUGGACUUCAAGG-3' | (SEQ ID NO: 3263) |
| AT3-757 19 nt Target #1: | 5'-UGGACUUCAAGGAAAAUGC-3' | (SEQ ID NO: 2496) |
| AT3-757 19 nt Target #2: | 5'-CUGGACUUCAAGGAAAAUG-3' | (SEQ ID NO: 2880) |
| AT3-757 19 nt Target #3: | 5'-CCUGGACUUCAAGGAAAAU-3' | (SEQ ID NO: 3264) |
| AT3-758 19 nt Target #1: | 5'-GGACUUCAAGGAAAAUGCA-3' | (SEQ ID NO: 2497) |
| AT3-758 19 nt Target #2: | 5'-UGGACUUCAAGGAAAAUGC-3' | (SEQ ID NO: 2881) |
| AT3-758 19 nt Target #3: | 5'-CUGGACUUCAAGGAAAAUG-3' | (SEQ ID NO: 3265) |
| AT3-759 19 nt Target #1: | 5'-GACUUCAAGGAAAAUGCAG-3' | (SEQ ID NO: 2498) |
| AT3-759 19 nt Target #2: | 5'-GGACUUCAAGGAAAAUGCA-3' | (SEQ ID NO: 2882) |
| AT3-759 19 nt Target #3: | 5'-UGGACUUCAAGGAAAAUGC-3' | (SEQ ID NO: 3266) |
| AT3-760 19 nt Target #1: | 5'-ACUUCAAGGAAAAUGCAGA-3' | (SEQ ID NO: 2499) |
| AT3-760 19 nt Target #2: | 5'-GACUUCAAGGAAAAUGCAG-3' | (SEQ ID NO: 2883) |
| AT3-760 19 nt Target #3: | 5'-GGACUUCAAGGAAAAUGCA-3' | (SEQ ID NO: 3267) |
| AT3-762 19 nt Target #1: | 5'-UUCAAGGAAAAUGCAGAGC-3' | (SEQ ID NO: 2500) |
| AT3-762 19 nt Target #2: | 5'-CUUCAAGGAAAAUGCAGAG-3' | (SEQ ID NO: 2884) |
| AT3-762 19 nt Target #3: | 5'-ACUUCAAGGAAAAUGCAGA-3' | (SEQ ID NO: 3268) |
| AT3-763 19 nt Target #1: | 5'-UCAAGGAAAAUGCAGAGCA-3' | (SEQ ID NO: 2501) |
| AT3-763 19 nt Target #2: | 5'-UUCAAGGAAAAUGCAGAGC-3' | (SEQ ID NO: 2885) |
| AT3-763 19 nt Target #3: | 5'-CUUCAAGGAAAAUGCAGAG-3' | (SEQ ID NO: 3269) |
| AT3-764 19 nt Target #1: | 5'-CAAGGAAAAUGCAGAGCAA-3' | (SEQ ID NO: 2502) |
| AT3-764 19 nt Target #2: | 5'-UCAAGGAAAAUGCAGAGCA-3' | (SEQ ID NO: 2886) |
| AT3-764 19 nt Target #3: | 5'-UUCAAGGAAAAUGCAGAGC-3' | (SEQ ID NO: 3270) |
| AT3-765 19 nt Target #1: | 5'-AAGGAAAAUGCAGAGCAAU-3' | (SEQ ID NO: 2503) |
| AT3-765 19 nt Target #2: | 5'-CAAGGAAAAUGCAGAGCAA-3' | (SEQ ID NO: 2887) |
| AT3-765 19 nt Target #3: | 5'-UCAAGGAAAAUGCAGAGCA-3' | (SEQ ID NO: 3271) |
| AT3-794 19 nt Target #1: | 5'-CAUCAACAAAUGGGUGUCC-3' | (SEQ ID NO: 2504) |
| AT3-794 19 nt Target #2: | 5'-CCAUCAACAAAUGGGUGUC-3' | (SEQ ID NO: 2888) |
| AT3-794 19 nt Target #3: | 5'-GCCAUCAACAAAUGGGUGU-3' | (SEQ ID NO: 3272) |

TABLE 6-continued

DsiRNA Component 19 Nucleotide Target Sequences in AT3 mRNA

| | | |
|---|---|---|
| AT3-795 19 nt Target #1: | 5'-AUCAACAAAUGGGUGUCCA-3' | (SEQ ID NO: 2505) |
| AT3-795 19 nt Target #2: | 5'-CAUCAACAAAUGGGUGUCC-3' | (SEQ ID NO: 2889) |
| AT3-795 19 nt Target #3: | 5'-CCAUCAACAAAUGGGUGUC-3' | (SEQ ID NO: 3273) |
| AT3-800 19 nt Target #1: | 5'-CAAAUGGGUGUCCAAUAAG-3' | (SEQ ID NO: 2506) |
| AT3-800 19 nt Target #2: | 5'-ACAAAUGGGUGUCCAAUAA-3' | (SEQ ID NO: 2890) |
| AT3-800 19 nt Target #3: | 5'-AACAAAUGGGUGUCCAAUA-3' | (SEQ ID NO: 3274) |
| AT3-864 19 nt Target #1: | 5'-GAGCUCACUGUUCUGGUGC-3' | (SEQ ID NO: 2507) |
| AT3-864 19 nt Target #2: | 5'-UGAGCUCACUGUUCUGGUG-3' | (SEQ ID NO: 2891) |
| AT3-864 19 nt Target #3: | 5'-AUGAGCUCACUGUUCUGGU-3' | (SEQ ID NO: 3275) |
| AT3-866 19 nt Target #1: | 5'-GCUCACUGUUCUGGUGCUG-3' | (SEQ ID NO: 2508) |
| AT3-866 19 nt Target #2: | 5'-AGCUCACUGUUCUGGUGCU-3' | (SEQ ID NO: 2892) |
| AT3-866 19 nt Target #3: | 5'-GAGCUCACUGUUCUGGUGC-3' | (SEQ ID NO: 3276) |
| AT3-867 19 nt Target #1: | 5'-CUCACUGUUCUGGUGCUGG-3' | (SEQ ID NO: 2509) |
| AT3-867 19 nt Target #2: | 5'-GCUCACUGUUCUGGUGCUG-3' | (SEQ ID NO: 2893) |
| AT3-867 19 nt Target #3: | 5'-AGCUCACUGUUCUGGUGCU-3' | (SEQ ID NO: 3277) |
| AT3-868 19 nt Target #1: | 5'-UCACUGUUCUGGUGCUGGU-3' | (SEQ ID NO: 2510) |
| AT3-868 19 nt Target #2: | 5'-CUCACUGUUCUGGUGCUGG-3' | (SEQ ID NO: 2894) |
| AT3-868 19 nt Target #3: | 5'-GCUCACUGUUCUGGUGCUG-3' | (SEQ ID NO: 3278) |
| AT3-869 19 nt Target #1: | 5'-CACUGUUCUGGUGCUGGUU-3' | (SEQ ID NO: 2511) |
| AT3-869 19 nt Target #2: | 5'-UCACUGUUCUGGUGCUGGU-3' | (SEQ ID NO: 2895) |
| AT3-869 19 nt Target #3: | 5'-CUCACUGUUCUGGUGCUGG-3' | (SEQ ID NO: 3279) |
| AT3-870 19 nt Target #1: | 5'-ACUGUUCUGGUGCUGGUUA-3' | (SEQ ID NO: 2512) |
| AT3-870 19 nt Target #2: | 5'-CACUGUUCUGGUGCUGGUU-3' | (SEQ ID NO: 2896) |
| AT3-870 19 nt Target #3: | 5'-UCACUGUUCUGGUGCUGGU-3' | (SEQ ID NO: 3280) |
| AT3-871 19 nt Target #1: | 5'-CUGUUCUGGUGCUGGUUAA-3' | (SEQ ID NO: 2513) |
| AT3-871 19 nt Target #2: | 5'-ACUGUUCUGGUGCUGGUUA-3' | (SEQ ID NO: 2897) |
| AT3-871 19 nt Target #3: | 5'-CACUGUUCUGGUGCUGGUU-3' | (SEQ ID NO: 3281) |
| AT3-872 19 nt Target #1: | 5'-UGUUCUGGUGCUGGUUAAC-3' | (SEQ ID NO: 2514) |
| AT3-872 19 nt Target #2: | 5'-CUGUUCUGGUGCUGGUUAA-3' | (SEQ ID NO: 2898) |
| AT3-872 19 nt Target #3: | 5'-ACUGUUCUGGUGCUGGUUA-3' | (SEQ ID NO: 3282) |
| AT3-873 19 nt Target #1: | 5'-GUUCUGGUGCUGGUUAACA-3' | (SEQ ID NO: 2515) |
| AT3-873 19 nt Target #2: | 5'-UGUUCUGGUGCUGGUUAAC-3' | (SEQ ID NO: 2899) |
| AT3-873 19 nt Target #3: | 5'-CUGUUCUGGUGCUGGUUAA-3' | (SEQ ID NO: 3283) |
| AT3-874 19 nt Target #1: | 5'-UUCUGGUGCUGGUUAACAC-3' | (SEQ ID NO: 2516) |
| AT3-874 19 nt Target #2: | 5'-GUUCUGGUGCUGGUUAACA-3' | (SEQ ID NO: 2900) |
| AT3-874 19 nt Target #3: | 5'-UGUUCUGGUGCUGGUUAAC-3' | (SEQ ID NO: 3284) |
| AT3-875 19 nt Target #1: | 5'-UCUGGUGCUGGUUAACACC-3' | (SEQ ID NO: 2517) |
| AT3-875 19 nt Target #2: | 5'-UUCUGGUGCUGGUUAACAC-3' | (SEQ ID NO: 2901) |
| AT3-875 19 nt Target #3: | 5'-GUUCUGGUGCUGGUUAACA-3' | (SEQ ID NO: 3285) |

TABLE 6-continued

DsiRNA Component 19 Nucleotide Target Sequences in AT3 mRNA

| | | |
|---|---|---|
| AT3-876 19 nt Target #1: | 5'-CUGGUGCUGGUUAACACCA-3' | (SEQ ID NO: 2518) |
| AT3-876 19 nt Target #2: | 5'-UCUGGUGCUGGUUAACACC-3' | (SEQ ID NO: 2902) |
| AT3-876 19 nt Target #3: | 5'-UUCUGGUGCUGGUUAACAC-3' | (SEQ ID NO: 3286) |
| AT3-877 19 nt Target #1: | 5'-UGGUGCUGGUUAACACCAU-3' | (SEQ ID NO: 2519) |
| AT3-877 19 nt Target #2: | 5'-CUGGUGCUGGUUAACACCA-3' | (SEQ ID NO: 2903) |
| AT3-877 19 nt Target #3: | 5'-UCUGGUGCUGGUUAACACC-3' | (SEQ ID NO: 3287) |
| AT3-878 19 nt Target #1: | 5'-GGUGCUGGUUAACACCAUU-3' | (SEQ ID NO: 2520) |
| AT3-878 19 nt Target #2: | 5'-UGGUGCUGGUUAACACCAU-3' | (SEQ ID NO: 2904) |
| AT3-878 19 nt Target #3: | 5'-CUGGUGCUGGUUAACACCA-3' | (SEQ ID NO: 3288) |
| AT3-879 19 nt Target #1: | 5'-GUGCUGGUUAACACCAUUU-3' | (SEQ ID NO: 2521) |
| AT3-879 19 nt Target #2: | 5'-GGUGCUGGUUAACACCAUU-3' | (SEQ ID NO: 2905) |
| AT3-879 19 nt Target #3: | 5'-UGGUGCUGGUUAACACCAU-3' | (SEQ ID NO: 3289) |
| AT3-880 19 nt Target #1: | 5'-UGCUGGUUAACACCAUUUA-3' | (SEQ ID NO: 2522) |
| AT3-880 19 nt Target #2: | 5'-GUGCUGGUUAACACCAUUU-3' | (SEQ ID NO: 2906) |
| AT3-880 19 nt Target #3: | 5'-GGUGCUGGUUAACACCAUU-3' | (SEQ ID NO: 3290) |
| AT3-881 19 nt Target #1: | 5'-GCUGGUUAACACCAUUUAC-3' | (SEQ ID NO: 2523) |
| AT3-881 19 nt Target #2: | 5'-UGCUGGUUAACACCAUUUA-3' | (SEQ ID NO: 2907) |
| AT3-881 19 nt Target #3: | 5'-GUGCUGGUUAACACCAUUU-3' | (SEQ ID NO: 3291) |
| AT3-882 19 nt Target #1: | 5'-CUGGUUAACACCAUUUACU-3' | (SEQ ID NO: 2524) |
| AT3-882 19 nt Target #2: | 5'-GCUGGUUAACACCAUUUAC-3' | (SEQ ID NO: 2908) |
| AT3-882 19 nt Target #3: | 5'-UGCUGGUUAACACCAUUUA-3' | (SEQ ID NO: 3292) |
| AT3-883 19 nt Target #1: | 5'-UGGUUAACACCAUUUACUU-3' | (SEQ ID NO: 2525) |
| AT3-883 19 nt Target #2: | 5'-CUGGUUAACACCAUUUACU-3' | (SEQ ID NO: 2909) |
| AT3-883 19 nt Target #3: | 5'-GCUGGUUAACACCAUUUAC-3' | (SEQ ID NO: 3293) |
| AT3-884 19 nt Target #1: | 5'-GGUUAACACCAUUUACUUC-3' | (SEQ ID NO: 2526) |
| AT3-884 19 nt Target #2: | 5'-UGGUUAACACCAUUUACUU-3' | (SEQ ID NO: 2910) |
| AT3-884 19 nt Target #3: | 5'-CUGGUUAACACCAUUUACU-3' | (SEQ ID NO: 3294) |
| AT3-885 19 nt Target #1: | 5'-GUUAACACCAUUUACUUCA-3' | (SEQ ID NO: 2527) |
| AT3-885 19 nt Target #2: | 5'-GGUUAACACCAUUUACUUC-3' | (SEQ ID NO: 2911) |
| AT3-885 19 nt Target #3: | 5'-UGGUUAACACCAUUUACUU-3' | (SEQ ID NO: 3295) |
| AT3-886 19 nt Target #1: | 5'-UUAACACCAUUUACUUCAA-3' | (SEQ ID NO: 2528) |
| AT3-886 19 nt Target #2: | 5'-GUUAACACCAUUUACUUCA-3' | (SEQ ID NO: 2912) |
| AT3-886 19 nt Target #3: | 5'-GGUUAACACCAUUUACUUC-3' | (SEQ ID NO: 3296) |
| AT3-887 19 nt Target #1: | 5'-UAACACCAUUUACUUCAAG-3' | (SEQ ID NO: 2529) |
| AT3-887 19 nt Target #2: | 5'-UUAACACCAUUUACUUCAA-3' | (SEQ ID NO: 2913) |
| AT3-887 19 nt Target #3: | 5'-GUUAACACCAUUUACUUCA-3' | (SEQ ID NO: 3297) |
| AT3-888 19 nt Target #1: | 5'-AACACCAUUUACUUCAAGG-3' | (SEQ ID NO: 2530) |
| AT3-888 19 nt Target #2: | 5'-UAACACCAUUUACUUCAAG-3' | (SEQ ID NO: 2914) |
| AT3-888 19 nt Target #3: | 5'-UUAACACCAUUUACUUCAA-3' | (SEQ ID NO: 3298) |

TABLE 6-continued

DsiRNA Component 19 Nucleotide Target Sequences in AT3 mRNA

| | | |
|---|---|---|
| AT3-889 19 nt Target #1: | 5'-ACACCAUUUACUUCAAGGG-3' | (SEQ ID NO: 2531) |
| AT3-889 19 nt Target #2: | 5'-AACACCAUUUACUUCAAGG-3' | (SEQ ID NO: 2915) |
| AT3-889 19 nt Target #3: | 5'-UAACACCAUUUACUUCAAG-3' | (SEQ ID NO: 3299) |
| AT3-890 19 nt Target #1: | 5'-CACCAUUUACUUCAAGGGC-3' | (SEQ ID NO: 2532) |
| AT3-890 19 nt Target #2: | 5'-ACACCAUUUACUUCAAGGG-3' | (SEQ ID NO: 2916) |
| AT3-890 19 nt Target #3: | 5'-AACACCAUUUACUUCAAGG-3' | (SEQ ID NO: 3300) |
| AT3-891 19 nt Target #1: | 5'-ACCAUUUACUUCAAGGGCC-3' | (SEQ ID NO: 2533) |
| AT3-891 19 nt Target #2: | 5'-CACCAUUUACUUCAAGGGC-3' | (SEQ ID NO: 2917) |
| AT3-891 19 nt Target #3: | 5'-ACACCAUUUACUUCAAGGG-3' | (SEQ ID NO: 3301) |
| AT3-892 19 nt Target #1: | 5'-CCAUUUACUUCAAGGGCCU-3' | (SEQ ID NO: 2534) |
| AT3-892 19 nt Target #2: | 5'-ACCAUUUACUUCAAGGGCC-3' | (SEQ ID NO: 2918) |
| AT3-892 19 nt Target #3: | 5'-CACCAUUUACUUCAAGGGC-3' | (SEQ ID NO: 3302) |
| AT3-893 19 nt Target #1: | 5'-CAUUUACUUCAAGGGCCUG-3' | (SEQ ID NO: 2535) |
| AT3-893 19 nt Target #2: | 5'-CCAUUUACUUCAAGGGCCU-3' | (SEQ ID NO: 2919) |
| AT3-893 19 nt Target #3: | 5'-ACCAUUUACUUCAAGGGCC-3' | (SEQ ID NO: 3303) |
| AT3-894 19 nt Target #1: | 5'-AUUUACUUCAAGGGCCUGU-3' | (SEQ ID NO: 2536) |
| AT3-894 19 nt Target #2: | 5'-CAUUUACUUCAAGGGCCUG-3' | (SEQ ID NO: 2920) |
| AT3-894 19 nt Target #3: | 5'-CCAUUUACUUCAAGGGCCU-3' | (SEQ ID NO: 3304) |
| AT3-895 19 nt Target #1: | 5'-UUUACUUCAAGGGCCUGUG-3' | (SEQ ID NO: 2537) |
| AT3-895 19 nt Target #2: | 5'-AUUUACUUCAAGGGCCUGU-3' | (SEQ ID NO: 2921) |
| AT3-895 19 nt Target #3: | 5'-CAUUUACUUCAAGGGCCUG-3' | (SEQ ID NO: 3305) |
| AT3-896 19 nt Target #1: | 5'-UUACUUCAAGGGCCUGUGG-3' | (SEQ ID NO: 2538) |
| AT3-896 19 nt Target #2: | 5'-UUUACUUCAAGGGCCUGUG-3' | (SEQ ID NO: 2922) |
| AT3-896 19 nt Target #3: | 5'-AUUUACUUCAAGGGCCUGU-3' | (SEQ ID NO: 3306) |
| AT3-897 19 nt Target #1: | 5'-UACUUCAAGGGCCUGUGGA-3' | (SEQ ID NO: 2539) |
| AT3-897 19 nt Target #2: | 5'-UUACUUCAAGGGCCUGUGG-3' | (SEQ ID NO: 2923) |
| AT3-897 19 nt Target #3: | 5'-UUUACUUCAAGGGCCUGUG-3' | (SEQ ID NO: 3307) |
| AT3-898 19 nt Target #1: | 5'-ACUUCAAGGGCCUGUGGAA-3' | (SEQ ID NO: 2540) |
| AT3-898 19 nt Target #2: | 5'-UACUUCAAGGGCCUGUGGA-3' | (SEQ ID NO: 2924) |
| AT3-898 19 nt Target #3: | 5'-UUACUUCAAGGGCCUGUGG-3' | (SEQ ID NO: 3308) |
| AT3-899 19 nt Target #1: | 5'-CUUCAAGGGCCUGUGGAAG-3' | (SEQ ID NO: 2541) |
| AT3-899 19 nt Target #2: | 5'-ACUUCAAGGGCCUGUGGAA-3' | (SEQ ID NO: 2925) |
| AT3-899 19 nt Target #3: | 5'-UACUUCAAGGGCCUGUGGA-3' | (SEQ ID NO: 3309) |
| AT3-900 19 nt Target #1: | 5'-UUCAAGGGCCUGUGGAAGU-3' | (SEQ ID NO: 2542) |
| AT3-900 19 nt Target #2: | 5'-CUUCAAGGGCCUGUGGAAG-3' | (SEQ ID NO: 2926) |
| AT3-900 19 nt Target #3: | 5'-ACUUCAAGGGCCUGUGGAA-3' | (SEQ ID NO: 3310) |
| AT3-901 19 nt Target #1: | 5'-UCAAGGGCCUGUGGAAGUC-3' | (SEQ ID NO: 2543) |
| AT3-901 19 nt Target #2: | 5'-UUCAAGGGCCUGUGGAAGU-3' | (SEQ ID NO: 2927) |
| AT3-901 19 nt Target #3: | 5'-CUUCAAGGGCCUGUGGAAG-3' | (SEQ ID NO: 3311) |

TABLE 6-continued

DsiRNA Component 19 Nucleotide Target Sequences in AT3 mRNA

| | | |
|---|---|---|
| AT3-902 19 nt Target #1: | 5'-CAAGGGCCUGUGGAAGUCA-3' | (SEQ ID NO: 2544) |
| AT3-902 19 nt Target #2: | 5'-UCAAGGGCCUGUGGAAGUC-3' | (SEQ ID NO: 2928) |
| AT3-902 19 nt Target #3: | 5'-UUCAAGGGCCUGUGGAAGU-3' | (SEQ ID NO: 3312) |
| AT3-903 19 nt Target #1: | 5'-AAGGGCCUGUGGAAGUCAA-3' | (SEQ ID NO: 2545) |
| AT3-903 19 nt Target #2: | 5'-CAAGGGCCUGUGGAAGUCA-3' | (SEQ ID NO: 2929) |
| AT3-903 19 nt Target #3: | 5'-UCAAGGGCCUGUGGAAGUC-3' | (SEQ ID NO: 3313) |
| AT3-904 19 nt Target #1: | 5'-AGGGCCUGUGGAAGUCAAA-3' | (SEQ ID NO: 2546) |
| AT3-904 19 nt Target #2: | 5'-AAGGGCCUGUGGAAGUCAA-3' | (SEQ ID NO: 2930) |
| AT3-904 19 nt Target #3: | 5'-CAAGGGCCUGUGGAAGUCA-3' | (SEQ ID NO: 3314) |
| AT3-905 19 nt Target #1: | 5'-GGGCCUGUGGAAGUCAAAG-3' | (SEQ ID NO: 2547) |
| AT3-905 19 nt Target #2: | 5'-AGGGCCUGUGGAAGUCAAA-3' | (SEQ ID NO: 2931) |
| AT3-905 19 nt Target #3: | 5'-AAGGGCCUGUGGAAGUCAA-3' | (SEQ ID NO: 3315) |
| AT3-906 19 nt Target #1: | 5'-GGCCUGUGGAAGUCAAAGU-3' | (SEQ ID NO: 2548) |
| AT3-906 19 nt Target #2: | 5'-GGGCCUGUGGAAGUCAAAG-3' | (SEQ ID NO: 2932) |
| AT3-906 19 nt Target #3: | 5'-AGGGCCUGUGGAAGUCAAA-3' | (SEQ ID NO: 3316) |
| AT3-907 19 nt Target #1: | 5'-GCCUGUGGAAGUCAAAGUU-3' | (SEQ ID NO: 2549) |
| AT3-907 19 nt Target #2: | 5'-GGCCUGUGGAAGUCAAAGU-3' | (SEQ ID NO: 2933) |
| AT3-907 19 nt Target #3: | 5'-GGGCCUGUGGAAGUCAAAG-3' | (SEQ ID NO: 3317) |
| AT3-908 19 nt Target #1: | 5'-CCUGUGGAAGUCAAAGUUC-3' | (SEQ ID NO: 2550) |
| AT3-908 19 nt Target #2: | 5'-GCCUGUGGAAGUCAAAGUU-3' | (SEQ ID NO: 2934) |
| AT3-908 19 nt Target #3: | 5'-GGCCUGUGGAAGUCAAAGU-3' | (SEQ ID NO: 3318) |
| AT3-909 19 nt Target #1: | 5'-CUGUGGAAGUCAAAGUUCA-3' | (SEQ ID NO: 2551) |
| AT3-909 19 nt Target #2: | 5'-CCUGUGGAAGUCAAAGUUC-3' | (SEQ ID NO: 2935) |
| AT3-909 19 nt Target #3: | 5'-GCCUGUGGAAGUCAAAGUU-3' | (SEQ ID NO: 3319) |
| AT3-910 19 nt Target #1: | 5'-UGUGGAAGUCAAAGUUCAG-3' | (SEQ ID NO: 2552) |
| AT3-910 19 nt Target #2: | 5'-CUGUGGAAGUCAAAGUUCA-3' | (SEQ ID NO: 2936) |
| AT3-910 19 nt Target #3: | 5'-CCUGUGGAAGUCAAAGUUC-3' | (SEQ ID NO: 3320) |
| AT3-911 19 nt Target #1: | 5'-GUGGAAGUCAAAGUUCAGC-3' | (SEQ ID NO: 2553) |
| AT3-911 19 nt Target #2: | 5'-UGUGGAAGUCAAAGUUCAG-3' | (SEQ ID NO: 2937) |
| AT3-911 19 nt Target #3: | 5'-CUGUGGAAGUCAAAGUUCA-3' | (SEQ ID NO: 3321) |
| AT3-912 19 nt Target #1: | 5'-UGGAAGUCAAAGUUCAGCC-3' | (SEQ ID NO: 2554) |
| AT3-912 19 nt Target #2: | 5'-GUGGAAGUCAAAGUUCAGC-3' | (SEQ ID NO: 2938) |
| AT3-912 19 nt Target #3: | 5'-UGUGGAAGUCAAAGUUCAG-3' | (SEQ ID NO: 3322) |
| AT3-913 19 nt Target #1: | 5'-GGAAGUCAAAGUUCAGCCC-3' | (SEQ ID NO: 2555) |
| AT3-913 19 nt Target #2: | 5'-UGGAAGUCAAAGUUCAGCC-3' | (SEQ ID NO: 2939) |
| AT3-913 19 nt Target #3: | 5'-GUGGAAGUCAAAGUUCAGC-3' | (SEQ ID NO: 3323) |
| AT3-914 19 nt Target #1: | 5'-GAAGUCAAAGUUCAGCCCU-3' | (SEQ ID NO: 2556) |
| AT3-914 19 nt Target #2: | 5'-GGAAGUCAAAGUUCAGCCC-3' | (SEQ ID NO: 2940) |
| AT3-914 19 nt Target #3: | 5'-UGGAAGUCAAAGUUCAGCC-3' | (SEQ ID NO: 3324) |

TABLE 6-continued

DsiRNA Component 19 Nucleotide Target Sequences in AT3 mRNA

| | | |
|---|---|---|
| AT3-915 19 nt Target #1: | 5'-AAGUCAAAGUUCAGCCCUG-3' | (SEQ ID NO: 2557) |
| AT3-915 19 nt Target #2: | 5'-GAAGUCAAAGUUCAGCCCU-3' | (SEQ ID NO: 2941) |
| AT3-915 19 nt Target #3: | 5'-GGAAGUCAAAGUUCAGCCC-3' | (SEQ ID NO: 3325) |
| AT3-916 19 nt Target #1: | 5'-AGUCAAAGUUCAGCCCUGA-3' | (SEQ ID NO: 2558) |
| AT3-916 19 nt Target #2: | 5'-AAGUCAAAGUUCAGCCCUG-3' | (SEQ ID NO: 2942) |
| AT3-916 19 nt Target #3: | 5'-GAAGUCAAAGUUCAGCCCU-3' | (SEQ ID NO: 3326) |
| AT3-959 19 nt Target #1: | 5'-CAAGGCUGAUGGAGAGUCG-3' | (SEQ ID NO: 2559) |
| AT3-959 19 nt Target #2: | 5'-ACAAGGCUGAUGGAGAGUC-3' | (SEQ ID NO: 2943) |
| AT3-959 19 nt Target #3: | 5'-UACAAGGCUGAUGGAGAGU-3' | (SEQ ID NO: 3327) |
| AT3-966 19 nt Target #1: | 5'-GAUGGAGAGUCGUGUUCAG-3' | (SEQ ID NO: 2560) |
| AT3-966 19 nt Target #2: | 5'-UGAUGGAGAGUCGUGUUCA-3' | (SEQ ID NO: 2944) |
| AT3-966 19 nt Target #3: | 5'-CUGAUGGAGAGUCGUGUUC-3' | (SEQ ID NO: 3328) |
| AT3-967 19 nt Target #1: | 5'-AUGGAGAGUCGUGUUCAGC-3' | (SEQ ID NO: 2561) |
| AT3-967 19 nt Target #2: | 5'-GAUGGAGAGUCGUGUUCAG-3' | (SEQ ID NO: 2945) |
| AT3-967 19 nt Target #3: | 5'-UGAUGGAGAGUCGUGUUCA-3' | (SEQ ID NO: 3329) |
| AT3-988 19 nt Target #1: | 5'-CUAUGAUGUACCAGGAAGG-3' | (SEQ ID NO: 2562) |
| AT3-988 19 nt Target #2: | 5'-UCUAUGAUGUACCAGGAAG-3' | (SEQ ID NO: 2946) |
| AT3-988 19 nt Target #3: | 5'-AUCUAUGAUGUACCAGGAA-3' | (SEQ ID NO: 3330) |
| AT3-989 19 nt Target #1: | 5'-UAUGAUGUACCAGGAAGGC-3' | (SEQ ID NO: 2563) |
| AT3-989 19 nt Target #2: | 5'-CUAUGAUGUACCAGGAAGG-3' | (SEQ ID NO: 2947) |
| AT3-989 19 nt Target #3: | 5'-UCUAUGAUGUACCAGGAAG-3' | (SEQ ID NO: 3331) |
| AT3-990 19 nt Target #1: | 5'-AUGAUGUACCAGGAAGGCA-3' | (SEQ ID NO: 2564) |
| AT3-990 19 nt Target #2: | 5'-UAUGAUGUACCAGGAAGGC-3' | (SEQ ID NO: 2948) |
| AT3-990 19 nt Target #3: | 5'-CUAUGAUGUACCAGGAAGG-3' | (SEQ ID NO: 3332) |
| AT3-991 19 nt Target #1: | 5'-UGAUGUACCAGGAAGGCAA-3' | (SEQ ID NO: 2565) |
| AT3-991 19 nt Target #2: | 5'-AUGAUGUACCAGGAAGGCA-3' | (SEQ ID NO: 2949) |
| AT3-991 19 nt Target #3: | 5'-UAUGAUGUACCAGGAAGGC-3' | (SEQ ID NO: 3333) |
| AT3-993 19 nt Target #1: | 5'-AUGUACCAGGAAGGCAAGU-3' | (SEQ ID NO: 2566) |
| AT3-993 19 nt Target #2: | 5'-GAUGUACCAGGAAGGCAAG-3' | (SEQ ID NO: 2950) |
| AT3-993 19 nt Target #3: | 5'-UGAUGUACCAGGAAGGCAA-3' | (SEQ ID NO: 3334) |
| AT3-1040 19 nt Target #1: | 5'-CCAGGUGCUUGAGUUGCCC-3' | (SEQ ID NO: 2567) |
| AT3-1040 19 nt Target #2: | 5'-CCCAGGUGCUUGAGUUGCC-3' | (SEQ ID NO: 2951) |
| AT3-1040 19 nt Target #3: | 5'-ACCCAGGUGCUUGAGUUGC-3' | (SEQ ID NO: 3335) |
| AT3-1043 19 nt Target #1: | 5'-GGUGCUUGAGUUGCCCUUC-3' | (SEQ ID NO: 2568) |
| AT3-1043 19 nt Target #2: | 5'-AGGUGCUUGAGUUGCCCUU-3' | (SEQ ID NO: 2952) |
| AT3-1043 19 nt Target #3: | 5'-CAGGUGCUUGAGUUGCCCU-3' | (SEQ ID NO: 3336) |
| AT3-1044 19 nt Target #1: | 5'-GUGCUUGAGUUGCCCUUCA-3' | (SEQ ID NO: 2569) |
| AT3-1044 19 nt Target #2: | 5'-GGUGCUUGAGUUGCCCUUC-3' | (SEQ ID NO: 2953) |
| AT3-1044 19 nt Target #3: | 5'-AGGUGCUUGAGUUGCCCUU-3' | (SEQ ID NO: 3337) |

TABLE 6-continued

DsiRNA Component 19 Nucleotide Target Sequences in AT3 mRNA

```
AT3-1045 19 nt Target #1:   5'-UGCUUGAGUUGCCCUUCAA-3'   (SEQ ID NO: 2570)
AT3-1045 19 nt Target #2:   5'-GUGCUUGAGUUGCCCUUCA-3'   (SEQ ID NO: 2954)
AT3-1045 19 nt Target #3:   5'-GGUGCUUGAGUUGCCCUUC-3'   (SEQ ID NO: 3338)
AT3-1065 19 nt Target #1:   5'-GGUGAUGACAUCACCAUGG-3'   (SEQ ID NO: 2571)
AT3-1065 19 nt Target #2:   5'-AGGUGAUGACAUCACCAUG-3'   (SEQ ID NO: 2955)
AT3-1065 19 nt Target #3:   5'-AAGGUGAUGACAUCACCAU-3'   (SEQ ID NO: 3339)
AT3-1066 19 nt Target #1:   5'-GUGAUGACAUCACCAUGGU-3'   (SEQ ID NO: 2572)
AT3-1066 19 nt Target #2:   5'-GGUGAUGACAUCACCAUGG-3'   (SEQ ID NO: 2956)
AT3-1066 19 nt Target #3:   5'-AGGUGAUGACAUCACCAUG-3'   (SEQ ID NO: 3340)
AT3-1093 19 nt Target #1:   5'-UGCCCAAGCCUGAGAAGAG-3'   (SEQ ID NO: 2573)
AT3-1093 19 nt Target #2:   5'-UUGCCCAAGCCUGAGAAGA-3'   (SEQ ID NO: 2957)
AT3-1093 19 nt Target #3:   5'-CUUGCCCAAGCCUGAGAAG-3'   (SEQ ID NO: 3341)
AT3-1094 19 nt Target #1:   5'-GCCCAAGCCUGAGAAGAGC-3'   (SEQ ID NO: 2574)
AT3-1094 19 nt Target #2:   5'-UGCCCAAGCCUGAGAAGAG-3'   (SEQ ID NO: 2958)
AT3-1094 19 nt Target #3:   5'-UUGCCCAAGCCUGAGAAGA-3'   (SEQ ID NO: 3342)
AT3-1095 19 nt Target #1:   5'-CCCAAGCCUGAGAAGAGCC-3'   (SEQ ID NO: 2575)
AT3-1095 19 nt Target #2:   5'-GCCCAAGCCUGAGAAGAGC-3'   (SEQ ID NO: 2959)
AT3-1095 19 nt Target #3:   5'-UGCCCAAGCCUGAGAAGAG-3'   (SEQ ID NO: 3343)
AT3-1096 19 nt Target #1:   5'-CCAAGCCUGAGAAGAGCCU-3'   (SEQ ID NO: 2576)
AT3-1096 19 nt Target #2:   5'-CCCAAGCCUGAGAAGAGCC-3'   (SEQ ID NO: 2960)
AT3-1096 19 nt Target #3:   5'-GCCCAAGCCUGAGAAGAGC-3'   (SEQ ID NO: 3344)
AT3-1097 19 nt Target #1:   5'-CAAGCCUGAGAAGAGCCUG-3'   (SEQ ID NO: 2577)
AT3-1097 19 nt Target #2:   5'-CCAAGCCUGAGAAGAGCCU-3'   (SEQ ID NO: 2961)
AT3-1097 19 nt Target #3:   5'-CCCAAGCCUGAGAAGAGCC-3'   (SEQ ID NO: 3345)
AT3-1098 19 nt Target #1:   5'-AAGCCUGAGAAGAGCCUGG-3'   (SEQ ID NO: 2578)
AT3-1098 19 nt Target #2:   5'-CAAGCCUGAGAAGAGCCUG-3'   (SEQ ID NO: 2962)
AT3-1098 19 nt Target #3:   5'-CCAAGCCUGAGAAGAGCCU-3'   (SEQ ID NO: 3346)
AT3-1099 19 nt Target #1:   5'-AGCCUGAGAAGAGCCUGGC-3'   (SEQ ID NO: 2579)
AT3-1099 19 nt Target #2:   5'-AAGCCUGAGAAGAGCCUGG-3'   (SEQ ID NO: 2963)
AT3-1099 19 nt Target #3:   5'-CAAGCCUGAGAAGAGCCUG-3'   (SEQ ID NO: 3347)
AT3-1100 19 nt Target #1:   5'-GCCUGAGAAGAGCCUGGCC-3'   (SEQ ID NO: 2580)
AT3-1100 19 nt Target #2:   5'-AGCCUGAGAAGAGCCUGGC-3'   (SEQ ID NO: 2964)
AT3-1100 19 nt Target #3:   5'-AAGCCUGAGAAGAGCCUGG-3'   (SEQ ID NO: 3348)
AT3-1101 19 nt Target #1:   5'-CCUGAGAAGAGCCUGGCCA-3'   (SEQ ID NO: 2581)
AT3-1101 19 nt Target #2:   5'-GCCUGAGAAGAGCCUGGCC-3'   (SEQ ID NO: 2965)
AT3-1101 19 nt Target #3:   5'-AGCCUGAGAAGAGCCUGGC-3'   (SEQ ID NO: 3349)
AT3-1102 19 nt Target #1:   5'-CUGAGAAGAGCCUGGCCAA-3'   (SEQ ID NO: 2582)
AT3-1102 19 nt Target #2:   5'-CCUGAGAAGAGCCUGGCCA-3'   (SEQ ID NO: 2966)
AT3-1102 19 nt Target #3:   5'-GCCUGAGAAGAGCCUGGCC-3'   (SEQ ID NO: 3350)
```

TABLE 6-continued

DsiRNA Component 19 Nucleotide Target Sequences in AT3 mRNA

| | | |
|---|---|---|
| AT3-1103 19 nt Target #1: | 5'-UGAGAAGAGCCUGGCCAAG-3' | (SEQ ID NO: 2583) |
| AT3-1103 19 nt Target #2: | 5'-CUGAGAAGAGCCUGGCCAA-3' | (SEQ ID NO: 2967) |
| AT3-1103 19 nt Target #3: | 5'-CCUGAGAAGAGCCUGGCCA-3' | (SEQ ID NO: 3351) |
| AT3-1104 19 nt Target #1: | 5'-GAGAAGAGCCUGGCCAAGG-3' | (SEQ ID NO: 2584) |
| AT3-1104 19 nt Target #2: | 5'-UGAGAAGAGCCUGGCCAAG-3' | (SEQ ID NO: 2968) |
| AT3-1104 19 nt Target #3: | 5'-CUGAGAAGAGCCUGGCCAA-3' | (SEQ ID NO: 3352) |
| AT3-1105 19 nt Target #1: | 5'-AGAAGAGCCUGGCCAAGGU-3' | (SEQ ID NO: 2585) |
| AT3-1105 19 nt Target #2: | 5'-GAGAAGAGCCUGGCCAAGG-3' | (SEQ ID NO: 2969) |
| AT3-1105 19 nt Target #3: | 5'-UGAGAAGAGCCUGGCCAAG-3' | (SEQ ID NO: 3353) |
| AT3-1188 19 nt Target #1: | 5'-GUGGUCCACAUGCCCGCU-3' | (SEQ ID NO: 2586) |
| AT3-1188 19 nt Target #2: | 5'-GGUGGUCCACAUGCCCGC-3' | (SEQ ID NO: 2970) |
| AT3-1188 19 nt Target #3: | 5'-UGGUGGUCCACAUGCCCG-3' | (SEQ ID NO: 3354) |
| AT3-1189 19 nt Target #1: | 5'-UGGUCCACAUGCCCGCUU-3' | (SEQ ID NO: 2587) |
| AT3-1189 19 nt Target #2: | 5'-GUGGUCCACAUGCCCGCU-3' | (SEQ ID NO: 2971) |
| AT3-1189 19 nt Target #3: | 5'-GGUGGUCCACAUGCCCGC-3' | (SEQ ID NO: 3355) |
| AT3-1190 19 nt Target #1: | 5'-GGUCCACAUGCCCGCUUC-3' | (SEQ ID NO: 2588) |
| AT3-1190 19 nt Target #2: | 5'-UGGUCCACAUGCCCGCUU-3' | (SEQ ID NO: 2972) |
| AT3-1190 19 nt Target #3: | 5'-GUGGUCCACAUGCCCGCU-3' | (SEQ ID NO: 3356) |
| AT3-1191 19 nt Target #1: | 5'-GUCCACAUGCCCGCUUCC-3' | (SEQ ID NO: 2589) |
| AT3-1191 19 nt Target #2: | 5'-GGUCCACAUGCCCGCUUC-3' | (SEQ ID NO: 2973) |
| AT3-1191 19 nt Target #3: | 5'-UGGUCCACAUGCCCGCUU-3' | (SEQ ID NO: 3357) |
| AT3-1192 19 nt Target #1: | 5'-UCCACAUGCCCGCUUCCG-3' | (SEQ ID NO: 2590) |
| AT3-1192 19 nt Target #2: | 5'-GUCCACAUGCCCGCUUCC-3' | (SEQ ID NO: 2974) |
| AT3-1192 19 nt Target #3: | 5'-GGUCCACAUGCCCGCUUC-3' | (SEQ ID NO: 3358) |
| AT3-1193 19 nt Target #1: | 5'-CCACAUGCCCGCUUCCGC-3' | (SEQ ID NO: 2591) |
| AT3-1193 19 nt Target #2: | 5'-UCCACAUGCCCGCUUCCG-3' | (SEQ ID NO: 2975) |
| AT3-1193 19 nt Target #3: | 5'-GUCCACAUGCCCGCUUCC-3' | (SEQ ID NO: 3359) |
| AT3-1194 19 nt Target #1: | 5'-CACAUGCCCGCUUCCGCA-3' | (SEQ ID NO: 2592) |
| AT3-1194 19 nt Target #2: | 5'-CCACAUGCCCGCUUCCGC-3' | (SEQ ID NO: 2976) |
| AT3-1194 19 nt Target #3: | 5'-UCCACAUGCCCGCUUCCG-3' | (SEQ ID NO: 3360) |
| AT3-1227 19 nt Target #1: | 5'-AGUUUGAAGGAGCAGCUGC-3' | (SEQ ID NO: 2593) |
| AT3-1227 19 nt Target #2: | 5'-CAGUUUGAAGGAGCAGCUG-3' | (SEQ ID NO: 2977) |
| AT3-1227 19 nt Target #3: | 5'-UCAGUUUGAAGGAGCAGCU-3' | (SEQ ID NO: 3361) |
| AT3-1228 19 nt Target #1: | 5'-GUUUGAAGGAGCAGCUGCA-3' | (SEQ ID NO: 2594) |
| AT3-1228 19 nt Target #2: | 5'-AGUUUGAAGGAGCAGCUGC-3' | (SEQ ID NO: 2978) |
| AT3-1228 19 nt Target #3: | 5'-CAGUUUGAAGGAGCAGCUG-3' | (SEQ ID NO: 3362) |
| AT3-1231 19 nt Target #1: | 5'-UGAAGGAGCAGCUGCAAGA-3' | (SEQ ID NO: 2595) |
| AT3-1231 19 nt Target #2: | 5'-UUGAAGGAGCAGCUGCAAG-3' | (SEQ ID NO: 2979) |
| AT3-1231 19 nt Target #3: | 5'-UUUGAAGGAGCAGCUGCAA-3' | (SEQ ID NO: 3363) |

TABLE 6-continued

DsiRNA Component 19 Nucleotide Target Sequences in AT3 mRNA

| | | |
|---|---|---|
| AT3-1232 19 nt Target #1: | 5'-GAAGGAGCAGCUGCAAGAC-3' | (SEQ ID NO: 2596) |
| AT3-1232 19 nt Target #2: | 5'-UGAAGGAGCAGCUGCAAGA-3' | (SEQ ID NO: 2980) |
| AT3-1232 19 nt Target #3: | 5'-UUGAAGGAGCAGCUGCAAG-3' | (SEQ ID NO: 3364) |
| AT3-1233 19 nt Target #1: | 5'-AAGGAGCAGCUGCAAGACA-3' | (SEQ ID NO: 2597) |
| AT3-1233 19 nt Target #2: | 5'-GAAGGAGCAGCUGCAAGAC-3' | (SEQ ID NO: 2981) |
| AT3-1233 19 nt Target #3: | 5'-UGAAGGAGCAGCUGCAAGA-3' | (SEQ ID NO: 3365) |
| AT3-1234 19 nt Target #1: | 5'-AGGAGCAGCUGCAAGACAU-3' | (SEQ ID NO: 2598) |
| AT3-1234 19 nt Target #2: | 5'-AAGGAGCAGCUGCAAGACA-3' | (SEQ ID NO: 2982) |
| AT3-1234 19 nt Target #3: | 5'-GAAGGAGCAGCUGCAAGAC-3' | (SEQ ID NO: 3366) |
| AT3-1235 19 nt Target #1: | 5'-GGAGCAGCUGCAAGACAUG-3' | (SEQ ID NO: 2599) |
| AT3-1235 19 nt Target #2: | 5'-AGGAGCAGCUGCAAGACAU-3' | (SEQ ID NO: 2983) |
| AT3-1235 19 nt Target #3: | 5'-AAGGAGCAGCUGCAAGACA-3' | (SEQ ID NO: 3367) |
| AT3-1236 19 nt Target #1: | 5'-GAGCAGCUGCAAGACAUGG-3' | (SEQ ID NO: 2600) |
| AT3-1236 19 nt Target #2: | 5'-GGAGCAGCUGCAAGACAUG-3' | (SEQ ID NO: 2984) |
| AT3-1236 19 nt Target #3: | 5'-AGGAGCAGCUGCAAGACAU-3' | (SEQ ID NO: 3368) |
| AT3-1237 19 nt Target #1: | 5'-AGCAGCUGCAAGACAUGGG-3' | (SEQ ID NO: 2601) |
| AT3-1237 19 nt Target #2: | 5'-GAGCAGCUGCAAGACAUGG-3' | (SEQ ID NO: 2985) |
| AT3-1237 19 nt Target #3: | 5'-GGAGCAGCUGCAAGACAUG-3' | (SEQ ID NO: 3369) |
| AT3-1238 19 nt Target #1: | 5'-GCAGCUGCAAGACAUGGGC-3' | (SEQ ID NO: 2602) |
| AT3-1238 19 nt Target #2: | 5'-AGCAGCUGCAAGACAUGGG-3' | (SEQ ID NO: 2986) |
| AT3-1238 19 nt Target #3: | 5'-GAGCAGCUGCAAGACAUGG-3' | (SEQ ID NO: 3370) |
| AT3-1239 19 nt Target #1: | 5'-CAGCUGCAAGACAUGGGCC-3' | (SEQ ID NO: 2603) |
| AT3-1239 19 nt Target #2: | 5'-GCAGCUGCAAGACAUGGGC-3' | (SEQ ID NO: 2987) |
| AT3-1239 19 nt Target #3: | 5'-AGCAGCUGCAAGACAUGGG-3' | (SEQ ID NO: 3371) |
| AT3-1240 19 nt Target #1: | 5'-AGCUGCAAGACAUGGGCCU-3' | (SEQ ID NO: 2604) |
| AT3-1240 19 nt Target #2: | 5'-CAGCUGCAAGACAUGGGCC-3' | (SEQ ID NO: 2988) |
| AT3-1240 19 nt Target #3: | 5'-GCAGCUGCAAGACAUGGGC-3' | (SEQ ID NO: 3372) |
| AT3-1258 19 nt Target #1: | 5'-UUGUCGAUCUGUUCAGCCC-3' | (SEQ ID NO: 2605) |
| AT3-1258 19 nt Target #2: | 5'-CUUGUCGAUCUGUUCAGCC-3' | (SEQ ID NO: 2989) |
| AT3-1258 19 nt Target #3: | 5'-CCUUGUCGAUCUGUUCAGC-3' | (SEQ ID NO: 3373) |
| AT3-1260 19 nt Target #1: | 5'-GUCGAUCUGUUCAGCCCUG-3' | (SEQ ID NO: 2606) |
| AT3-1260 19 nt Target #2: | 5'-UGUCGAUCUGUUCAGCCCU-3' | (SEQ ID NO: 2990) |
| AT3-1260 19 nt Target #3: | 5'-UUGUCGAUCUGUUCAGCCC-3' | (SEQ ID NO: 3374) |
| AT3-1261 19 nt Target #1: | 5'-UCGAUCUGUUCAGCCCUGA-3' | (SEQ ID NO: 2607) |
| AT3-1261 19 nt Target #2: | 5'-GUCGAUCUGUUCAGCCCUG-3' | (SEQ ID NO: 2991) |
| AT3-1261 19 nt Target #3: | 5'-UGUCGAUCUGUUCAGCCCU-3' | (SEQ ID NO: 3375) |
| AT3-1263 19 nt Target #1: | 5'-GAUCUGUUCAGCCCUGAAA-3' | (SEQ ID NO: 2608) |
| AT3-1263 19 nt Target #2: | 5'-CGAUCUGUUCAGCCCUGAA-3' | (SEQ ID NO: 2992) |
| AT3-1263 19 nt Target #3: | 5'-UCGAUCUGUUCAGCCCUGA-3' | (SEQ ID NO: 3376) |

TABLE 6-continued

DsiRNA Component 19 Nucleotide Target Sequences in AT3 mRNA

| | | |
|---|---|---|
| AT3-1266 19 nt Target #1: | 5'-CUGUUCAGCCCUGAAAAGU-3' | (SEQ ID NO: 2609) |
| AT3-1266 19 nt Target #2: | 5'-UCUGUUCAGCCCUGAAAAG-3' | (SEQ ID NO: 2993) |
| AT3-1266 19 nt Target #3: | 5'-AUCUGUUCAGCCCUGAAAA-3' | (SEQ ID NO: 3377) |
| AT3-1268 19 nt Target #1: | 5'-GUUCAGCCCUGAAAAGUCC-3' | (SEQ ID NO: 2610) |
| AT3-1268 19 nt Target #2: | 5'-UGUUCAGCCCUGAAAAGUC-3' | (SEQ ID NO: 2994) |
| AT3-1268 19 nt Target #3: | 5'-CUGUUCAGCCCUGAAAAGU-3' | (SEQ ID NO: 3378) |
| AT3-1280 19 nt Target #1: | 5'-AAAGUCCAAACUCCCAGGU-3' | (SEQ ID NO: 2611) |
| AT3-1280 19 nt Target #2: | 5'-AAAAGUCCAAACUCCCAGG-3' | (SEQ ID NO: 2995) |
| AT3-1280 19 nt Target #3: | 5'-GAAAAGUCCAAACUCCCAG-3' | (SEQ ID NO: 3379) |
| AT3-1281 19 nt Target #1: | 5'-AAGUCCAAACUCCCAGGUA-3' | (SEQ ID NO: 2612) |
| AT3-1281 19 nt Target #2: | 5'-AAAGUCCAAACUCCCAGGU-3' | (SEQ ID NO: 2996) |
| AT3-1281 19 nt Target #3: | 5'-AAAAGUCCAAACUCCCAGG-3' | (SEQ ID NO: 3380) |
| AT3-1283 19 nt Target #1: | 5'-GUCCAAACUCCCAGGUAUU-3' | (SEQ ID NO: 2613) |
| AT3-1283 19 nt Target #2: | 5'-AGUCCAAACUCCCAGGUAU-3' | (SEQ ID NO: 2997) |
| AT3-1283 19 nt Target #3: | 5'-AAGUCCAAACUCCCAGGUA-3' | (SEQ ID NO: 3381) |
| AT3-1285 19 nt Target #1: | 5'-CCAAACUCCCAGGUAUUGU-3' | (SEQ ID NO: 2614) |
| AT3-1285 19 nt Target #2: | 5'-UCCAAACUCCCAGGUAUUG-3' | (SEQ ID NO: 2998) |
| AT3-1285 19 nt Target #3: | 5'-GUCCAAACUCCCAGGUAUU-3' | (SEQ ID NO: 3382) |
| AT3-1286 19 nt Target #1: | 5'-CAAACUCCCAGGUAUUGUU-3' | (SEQ ID NO: 2615) |
| AT3-1286 19 nt Target #2: | 5'-CCAAACUCCCAGGUAUUGU-3' | (SEQ ID NO: 2999) |
| AT3-1286 19 nt Target #3: | 5'-UCCAAACUCCCAGGUAUUG-3' | (SEQ ID NO: 3383) |
| AT3-1287 19 nt Target #1: | 5'-AAACUCCCAGGUAUUGUUG-3' | (SEQ ID NO: 2616) |
| AT3-1287 19 nt Target #2: | 5'-CAAACUCCCAGGUAUUGUU-3' | (SEQ ID NO: 3000) |
| AT3-1287 19 nt Target #3: | 5'-CCAAACUCCCAGGUAUUGU-3' | (SEQ ID NO: 3384) |
| AT3-1288 19 nt Target #1: | 5'-AACUCCCAGGUAUUGUUGC-3' | (SEQ ID NO: 2617) |
| AT3-1288 19 nt Target #2: | 5'-AAACUCCCAGGUAUUGUUG-3' | (SEQ ID NO: 3001) |
| AT3-1288 19 nt Target #3: | 5'-CAAACUCCCAGGUAUUGUU-3' | (SEQ ID NO: 3385) |
| AT3-1344 19 nt Target #1: | 5'-CAUAAGGCAUUUCUUGAGG-3' | (SEQ ID NO: 2618) |
| AT3-1344 19 nt Target #2: | 5'-CCAUAAGGCAUUUCUUGAG-3' | (SEQ ID NO: 3002) |
| AT3-1344 19 nt Target #3: | 5'-UCCAUAAGGCAUUUCUUGA-3' | (SEQ ID NO: 3386) |
| AT3-1345 19 nt Target #1: | 5'-AUAAGGCAUUUCUUGAGGU-3' | (SEQ ID NO: 2619) |
| AT3-1345 19 nt Target #2: | 5'-CAUAAGGCAUUUCUUGAGG-3' | (SEQ ID NO: 3003) |
| AT3-1345 19 nt Target #3: | 5'-CCAUAAGGCAUUUCUUGAG-3' | (SEQ ID NO: 3387) |
| AT3-1346 19 nt Target #1: | 5'-UAAGGCAUUUCUUGAGGUA-3' | (SEQ ID NO: 2620) |
| AT3-1346 19 nt Target #2: | 5'-AUAAGGCAUUUCUUGAGGU-3' | (SEQ ID NO: 3004) |
| AT3-1346 19 nt Target #3: | 5'-CAUAAGGCAUUUCUUGAGG-3' | (SEQ ID NO: 3388) |
| AT3-1347 19 nt Target #1: | 5'-AAGGCAUUUCUUGAGGUAA-3' | (SEQ ID NO: 2621) |
| AT3-1347 19 nt Target #2: | 5'-UAAGGCAUUUCUUGAGGUA-3' | (SEQ ID NO: 3005) |
| AT3-1347 19 nt Target #3: | 5'-AUAAGGCAUUUCUUGAGGU-3' | (SEQ ID NO: 3389) |

TABLE 6-continued

DsiRNA Component 19 Nucleotide Target Sequences in AT3 mRNA

| | | | |
|---|---|---|---|
| AT3-1348 19 nt Target #1: | 5'-AGGCAUUUCUUGAGGUAAA-3' | (SEQ ID NO: 2622) |
| AT3-1348 19 nt Target #2: | 5'-AAGGCAUUUCUUGAGGUAA-3' | (SEQ ID NO: 3006) |
| AT3-1348 19 nt Target #3: | 5'-UAAGGCAUUUCUUGAGGUA-3' | (SEQ ID NO: 3390) |
| AT3-1349 19 nt Target #1: | 5'-GGCAUUUCUUGAGGUAAAU-3' | (SEQ ID NO: 2623) |
| AT3-1349 19 nt Target #2: | 5'-AGGCAUUUCUUGAGGUAAA-3' | (SEQ ID NO: 3007) |
| AT3-1349 19 nt Target #3: | 5'-AAGGCAUUUCUUGAGGUAA-3' | (SEQ ID NO: 3391) |
| AT3-1350 19 nt Target #1: | 5'-GCAUUUCUUGAGGUAAAUG-3' | (SEQ ID NO: 2624) |
| AT3-1350 19 nt Target #2: | 5'-GGCAUUUCUUGAGGUAAAU-3' | (SEQ ID NO: 3008) |
| AT3-1350 19 nt Target #3: | 5'-AGGCAUUUCUUGAGGUAAA-3' | (SEQ ID NO: 3392) |
| AT3-1351 19 nt Target #1: | 5'-CAUUUCUUGAGGUAAAUGA-3' | (SEQ ID NO: 2625) |
| AT3-1351 19 nt Target #2: | 5'-GCAUUUCUUGAGGUAAAUG-3' | (SEQ ID NO: 3009) |
| AT3-1351 19 nt Target #3: | 5'-GGCAUUUCUUGAGGUAAAU-3' | (SEQ ID NO: 3393) |
| AT3-1358 19 nt Target #1: | 5'-UGAGGUAAAUGAAGAAGGC-3' | (SEQ ID NO: 2626) |
| AT3-1358 19 nt Target #2: | 5'-UUGAGGUAAAUGAAGAAGG-3' | (SEQ ID NO: 3010) |
| AT3-1358 19 nt Target #3: | 5'-CUUGAGGUAAAUGAAGAAG-3' | (SEQ ID NO: 3394) |
| AT3-1359 19 nt Target #1: | 5'-GAGGUAAAUGAAGAAGGCA-3' | (SEQ ID NO: 2627) |
| AT3-1359 19 nt Target #2: | 5'-UGAGGUAAAUGAAGAAGGC-3' | (SEQ ID NO: 3011) |
| AT3-1359 19 nt Target #3: | 5'-UUGAGGUAAAUGAAGAAGG-3' | (SEQ ID NO: 3395) |
| AT3-1360 19 nt Target #1: | 5'-AGGUAAAUGAAGAAGGCAG-3' | (SEQ ID NO: 2628) |
| AT3-1360 19 nt Target #2: | 5'-GAGGUAAAUGAAGAAGGCA-3' | (SEQ ID NO: 3012) |
| AT3-1360 19 nt Target #3: | 5'-UGAGGUAAAUGAAGAAGGC-3' | (SEQ ID NO: 3396) |
| AT3-1361 19 nt Target #1: | 5'-GGUAAAUGAAGAAGGCAGU-3' | (SEQ ID NO: 2629) |
| AT3-1361 19 nt Target #2: | 5'-AGGUAAAUGAAGAAGGCAG-3' | (SEQ ID NO: 3013) |
| AT3-1361 19 nt Target #3: | 5'-GAGGUAAAUGAAGAAGGCA-3' | (SEQ ID NO: 3397) |
| AT3-1362 19 nt Target #1: | 5'-GUAAAUGAAGAAGGCAGUG-3' | (SEQ ID NO: 2630) |
| AT3-1362 19 nt Target #2: | 5'-GGUAAAUGAAGAAGGCAGU-3' | (SEQ ID NO: 3014) |
| AT3-1362 19 nt Target #3: | 5'-AGGUAAAUGAAGAAGGCAG-3' | (SEQ ID NO: 3398) |
| AT3-1363 19 nt Target #1: | 5'-UAAAUGAAGAAGGCAGUGA-3' | (SEQ ID NO: 2631) |
| AT3-1363 19 nt Target #2: | 5'-GUAAAUGAAGAAGGCAGUG-3' | (SEQ ID NO: 3015) |
| AT3-1363 19 nt Target #3: | 5'-GGUAAAUGAAGAAGGCAGU-3' | (SEQ ID NO: 3399) |
| AT3-1364 19 nt Target #1: | 5'-AAAUGAAGAAGGCAGUGAA-3' | (SEQ ID NO: 2632) |
| AT3-1364 19 nt Target #2: | 5'-UAAAUGAAGAAGGCAGUGA-3' | (SEQ ID NO: 3016) |
| AT3-1364 19 nt Target #3: | 5'-GUAAAUGAAGAAGGCAGUG-3' | (SEQ ID NO: 3400) |
| AT3-1369 19 nt Target #1: | 5'-AAGAAGGCAGUGAAGCAGC-3' | (SEQ ID NO: 2633) |
| AT3-1369 19 nt Target #2: | 5'-GAAGAAGGCAGUGAAGCAG-3' | (SEQ ID NO: 3017) |
| AT3-1369 19 nt Target #3: | 5'-UGAAGAAGGCAGUGAAGCA-3' | (SEQ ID NO: 3401) |
| AT3-1372 19 nt Target #1: | 5'-AAGGCAGUGAAGCAGCUGC-3' | (SEQ ID NO: 2634) |
| AT3-1372 19 nt Target #2: | 5'-GAAGGCAGUGAAGCAGCUG-3' | (SEQ ID NO: 3018) |
| AT3-1372 19 nt Target #3: | 5'-AGAAGGCAGUGAAGCAGCU-3' | (SEQ ID NO: 3402) |

TABLE 6-continued

DsiRNA Component 19 Nucleotide Target Sequences in AT3 mRNA

| | | |
|---|---|---|
| AT3-1373 19 nt Target #1: | 5'-AGGCAGUGAAGCAGCUGCA-3' | (SEQ ID NO: 2635) |
| AT3-1373 19 nt Target #2: | 5'-AAGGCAGUGAAGCAGCUGC-3' | (SEQ ID NO: 3019) |
| AT3-1373 19 nt Target #3: | 5'-GAAGGCAGUGAAGCAGCUG-3' | (SEQ ID NO: 3403) |
| AT3-1381 19 nt Target #1: | 5'-AAGCAGCUGCAAGUACCGC-3' | (SEQ ID NO: 2636) |
| AT3-1381 19 nt Target #2: | 5'-GAAGCAGCUGCAAGUACCG-3' | (SEQ ID NO: 3020) |
| AT3-1381 19 nt Target #3: | 5'-UGAAGCAGCUGCAAGUACC-3' | (SEQ ID NO: 3404) |
| AT3-1452 19 nt Target #1: | 5'-AACAGGCCUUUCCUGGUUU-3' | (SEQ ID NO: 2637) |
| AT3-1452 19 nt Target #2: | 5'-CAACAGGCCUUUCCUGGUU-3' | (SEQ ID NO: 3021) |
| AT3-1452 19 nt Target #3: | 5'-CCAACAGGCCUUUCCUGGU-3' | (SEQ ID NO: 3405) |
| AT3-1453 19 nt Target #1: | 5'-ACAGGCCUUUCCUGGUUUU-3' | (SEQ ID NO: 2638) |
| AT3-1453 19 nt Target #2: | 5'-AACAGGCCUUUCCUGGUUU-3' | (SEQ ID NO: 3022) |
| AT3-1453 19 nt Target #3: | 5'-CAACAGGCCUUUCCUGGUU-3' | (SEQ ID NO: 3406) |
| AT3-1454 19 nt Target #1: | 5'-CAGGCCUUUCCUGGUUUUU-3' | (SEQ ID NO: 2639) |
| AT3-1454 19 nt Target #2: | 5'-ACAGGCCUUUCCUGGUUUU-3' | (SEQ ID NO: 3023) |
| AT3-1454 19 nt Target #3: | 5'-AACAGGCCUUUCCUGGUUU-3' | (SEQ ID NO: 3407) |
| AT3-1455 19 nt Target #1: | 5'-AGGCCUUUCCUGGUUUUUA-3' | (SEQ ID NO: 2640) |
| AT3-1455 19 nt Target #2: | 5'-CAGGCCUUUCCUGGUUUUU-3' | (SEQ ID NO: 3024) |
| AT3-1455 19 nt Target #3: | 5'-ACAGGCCUUUCCUGGUUUU-3' | (SEQ ID NO: 3408) |
| AT3-1456 19 nt Target #1: | 5'-GGCCUUUCCUGGUUUUUAU-3' | (SEQ ID NO: 2641) |
| AT3-1456 19 nt Target #2: | 5'-AGGCCUUUCCUGGUUUUUA-3' | (SEQ ID NO: 3025) |
| AT3-1456 19 nt Target #3: | 5'-CAGGCCUUUCCUGGUUUUU-3' | (SEQ ID NO: 3409) |
| AT3-1457 19 nt Target #1: | 5'-GCCUUUCCUGGUUUUUAUA-3' | (SEQ ID NO: 2642) |
| AT3-1457 19 nt Target #2: | 5'-GGCCUUUCCUGGUUUUUAU-3' | (SEQ ID NO: 3026) |
| AT3-1457 19 nt Target #3: | 5'-AGGCCUUUCCUGGUUUUUA-3' | (SEQ ID NO: 3410) |
| AT3-1459 19 nt Target #1: | 5'-CUUUCCUGGUUUUUAUAAG-3' | (SEQ ID NO: 2643) |
| AT3-1459 19 nt Target #2: | 5'-CCUUUCCUGGUUUUUAUAA-3' | (SEQ ID NO: 3027) |
| AT3-1459 19 nt Target #3: | 5'-GCCUUUCCUGGUUUUUAUA-3' | (SEQ ID NO: 3411) |
| AT3-1460 19 nt Target #1: | 5'-UUUCCUGGUUUUUAUAAGA-3' | (SEQ ID NO: 2644) |
| AT3-1460 19 nt Target #2: | 5'-CUUUCCUGGUUUUUAUAAG-3' | (SEQ ID NO: 3028) |
| AT3-1460 19 nt Target #3: | 5'-CCUUUCCUGGUUUUUAUAA-3' | (SEQ ID NO: 3412) |
| AT3-1461 19 nt Target #1: | 5'-UUCCUGGUUUUUAUAAGAG-3' | (SEQ ID NO: 2645) |
| AT3-1461 19 nt Target #2: | 5'-UUUCCUGGUUUUUAUAAGA-3' | (SEQ ID NO: 3029) |
| AT3-1461 19 nt Target #3: | 5'-CUUUCCUGGUUUUUAUAAG-3' | (SEQ ID NO: 3413) |
| AT3-1462 19 nt Target #1: | 5'-UCCUGGUUUUUAUAAGAGA-3' | (SEQ ID NO: 2646) |
| AT3-1462 19 nt Target #2: | 5'-UUCCUGGUUUUUAUAAGAG-3' | (SEQ ID NO: 3030) |
| AT3-1462 19 nt Target #3: | 5'-UUUCCUGGUUUUUAUAAGA-3' | (SEQ ID NO: 3414) |
| AT3-1463 19 nt Target #1: | 5'-CCUGGUUUUUAUAAGAGAA-3' | (SEQ ID NO: 2647) |
| AT3-1463 19 nt Target #2: | 5'-UCCUGGUUUUUAUAAGAGA-3' | (SEQ ID NO: 3031) |
| AT3-1463 19 nt Target #3: | 5'-UUCCUGGUUUUUAUAAGAG-3' | (SEQ ID NO: 3415) |

TABLE 6-continued

DsiRNA Component 19 Nucleotide Target Sequences in AT3 mRNA

```
AT3-1464 19 nt Target #1:   5'-CUGGUUUUUAUAAGAGAAG-3'   (SEQ ID NO: 2648)

AT3-1464 19 nt Target #2:   5'-CCUGGUUUUUAUAAGAGAA-3'   (SEQ ID NO: 3032)

AT3-1464 19 nt Target #3:   5'-UCCUGGUUUUUAUAAGAGA-3'   (SEQ ID NO: 3416)

AT3-1465 19 nt Target #1:   5'-UGGUUUUUAUAAGAGAAGU-3'   (SEQ ID NO: 2649)

AT3-1465 19 nt Target #2:   5'-CUGGUUUUUAUAAGAGAAG-3'   (SEQ ID NO: 3033)

AT3-1465 19 nt Target #3:   5'-CCUGGUUUUUAUAAGAGAA-3'   (SEQ ID NO: 3417)

AT3-1466 19 nt Target #1:   5'-GGUUUUUAUAAGAGAAGUU-3'   (SEQ ID NO: 2650)

AT3-1466 19 nt Target #2:   5'-UGGUUUUUAUAAGAGAAGU-3'   (SEQ ID NO: 3034)

AT3-1466 19 nt Target #3:   5'-CUGGUUUUUAUAAGAGAAG-3'   (SEQ ID NO: 3418)

AT3-1467 19 nt Target #1:   5'-GUUUUUAUAAGAGAAGUUC-3'   (SEQ ID NO: 2651)

AT3-1467 19 nt Target #2:   5'-GGUUUUUAUAAGAGAAGUU-3'   (SEQ ID NO: 3035)

AT3-1467 19 nt Target #3:   5'-UGGUUUUUAUAAGAGAAGU-3'   (SEQ ID NO: 3419)

AT3-1468 19 nt Target #1:   5'-UUUUUAUAAGAGAAGUUCC-3'   (SEQ ID NO: 2652)

AT3-1468 19 nt Target #2:   5'-GUUUUUAUAAGAGAAGUUC-3'   (SEQ ID NO: 3036)

AT3-1468 19 nt Target #3:   5'-GGUUUUUAUAAGAGAAGUU-3'   (SEQ ID NO: 3420)

AT3-1469 19 nt Target #1:   5'-UUUUAUAAGAGAAGUUCCU-3'   (SEQ ID NO: 2653)

AT3-1469 19 nt Target #2:   5'-UUUUUAUAAGAGAAGUUCC-3'   (SEQ ID NO: 3037)

AT3-1469 19 nt Target #3:   5'-GUUUUUAUAAGAGAAGUUC-3'   (SEQ ID NO: 3421)

AT3-1470 19 nt Target #1:   5'-UUUAUAAGAGAAGUUCCUC-3'   (SEQ ID NO: 2654)

AT3-1470 19 nt Target #2:   5'-UUUUAUAAGAGAAGUUCCU-3'   (SEQ ID NO: 3038)

AT3-1470 19 nt Target #3:   5'-UUUUUAUAAGAGAAGUUCC-3'   (SEQ ID NO: 3422)

AT3-1471 19 nt Target #1:   5'-UUAUAAGAGAAGUUCCUCU-3'   (SEQ ID NO: 2655)

AT3-1471 19 nt Target #2:   5'-UUUAUAAGAGAAGUUCCUC-3'   (SEQ ID NO: 3039)

AT3-1471 19 nt Target #3:   5'-UUUUAUAAGAGAAGUUCCU-3'   (SEQ ID NO: 3423)

AT3-1472 19 nt Target #1:   5'-UAUAAGAGAAGUUCCUCUG-3'   (SEQ ID NO: 2656)

AT3-1472 19 nt Target #2:   5'-UUAUAAGAGAAGUUCCUCU-3'   (SEQ ID NO: 3040)

AT3-1472 19 nt Target #3:   5'-UUUAUAAGAGAAGUUCCUC-3'   (SEQ ID NO: 3424)

AT3-1473 19 nt Target #1:   5'-AUAAGAGAAGUUCCUCUGA-3'   (SEQ ID NO: 2657)

AT3-1473 19 nt Target #2:   5'-UAUAAGAGAAGUUCCUCUG-3'   (SEQ ID NO: 3041)

AT3-1473 19 nt Target #3:   5'-UUAUAAGAGAAGUUCCUCU-3'   (SEQ ID NO: 3425)

AT3-1474 19 nt Target #1:   5'-UAAGAGAAGUUCCUCUGAA-3'   (SEQ ID NO: 2658)

AT3-1474 19 nt Target #2:   5'-AUAAGAGAAGUUCCUCUGA-3'   (SEQ ID NO: 3042)

AT3-1474 19 nt Target #3:   5'-UAUAAGAGAAGUUCCUCUG-3'   (SEQ ID NO: 3426)

AT3-1475 19 nt Target #1:   5'-AAGAGAAGUUCCUCUGAAC-3'   (SEQ ID NO: 2659)

AT3-1475 19 nt Target #2:   5'-UAAGAGAAGUUCCUCUGAA-3'   (SEQ ID NO: 3043)

AT3-1475 19 nt Target #3:   5'-AUAAGAGAAGUUCCUCUGA-3'   (SEQ ID NO: 3427)

AT3-1476 19 nt Target #1:   5'-AGAGAAGUUCCUCUGAACA-3'   (SEQ ID NO: 2660)

AT3-1476 19 nt Target #2:   5'-AAGAGAAGUUCCUCUGAAC-3'   (SEQ ID NO: 3044)

AT3-1476 19 nt Target #3:   5'-UAAGAGAAGUUCCUCUGAA-3'   (SEQ ID NO: 3428)
```

TABLE 6-continued

DsiRNA Component 19 Nucleotide Target Sequences in AT3 mRNA

| | | |
|---|---|---|
| AT3-1477 19 nt Target #1: | 5'-GAGAAGUUCCUCUGAACAC-3' | (SEQ ID NO: 2661) |
| AT3-1477 19 nt Target #2: | 5'-AGAGAAGUUCCUCUGAACA-3' | (SEQ ID NO: 3045) |
| AT3-1477 19 nt Target #3: | 5'-AAGAGAAGUUCCUCUGAAC-3' | (SEQ ID NO: 3429) |
| AT3-1478 19 nt Target #1: | 5'-AGAAGUUCCUCUGAACACU-3' | (SEQ ID NO: 2662) |
| AT3-1478 19 nt Target #2: | 5'-GAGAAGUUCCUCUGAACAC-3' | (SEQ ID NO: 3046) |
| AT3-1478 19 nt Target #3: | 5'-AGAGAAGUUCCUCUGAACA-3' | (SEQ ID NO: 3430) |
| AT3-1479 19 nt Target #1: | 5'-GAAGUUCCUCUGAACACUA-3' | (SEQ ID NO: 2663) |
| AT3-1479 19 nt Target #2: | 5'-AGAAGUUCCUCUGAACACU-3' | (SEQ ID NO: 3047) |
| AT3-1479 19 nt Target #3: | 5'-GAGAAGUUCCUCUGAACAC-3' | (SEQ ID NO: 3431) |
| AT3-1480 19 nt Target #1: | 5'-AAGUUCCUCUGAACACUAU-3' | (SEQ ID NO: 2664) |
| AT3-1480 19 nt Target #2: | 5'-GAAGUUCCUCUGAACACUA-3' | (SEQ ID NO: 3048) |
| AT3-1480 19 nt Target #3: | 5'-AGAAGUUCCUCUGAACACU-3' | (SEQ ID NO: 3432) |
| AT3-1481 19 nt Target #1: | 5'-AGUUCCUCUGAACACUAUU-3' | (SEQ ID NO: 2665) |
| AT3-1481 19 nt Target #2: | 5'-AAGUUCCUCUGAACACUAU-3' | (SEQ ID NO: 3049) |
| AT3-1481 19 nt Target #3: | 5'-GAAGUUCCUCUGAACACUA-3' | (SEQ ID NO: 3433) |
| AT3-1482 19 nt Target #1: | 5'-GUUCCUCUGAACACUAUUA-3' | (SEQ ID NO: 2666) |
| AT3-1482 19 nt Target #2: | 5'-AGUUCCUCUGAACACUAUU-3' | (SEQ ID NO: 3050) |
| AT3-1482 19 nt Target #3: | 5'-AAGUUCCUCUGAACACUAU-3' | (SEQ ID NO: 3434) |
| AT3-1483 19 nt Target #1: | 5'-UUCCUCUGAACACUAUUAU-3' | (SEQ ID NO: 2667) |
| AT3-1483 19 nt Target #2: | 5'-GUUCCUCUGAACACUAUUA-3' | (SEQ ID NO: 3051) |
| AT3-1483 19 nt Target #3: | 5'-AGUUCCUCUGAACACUAUU-3' | (SEQ ID NO: 3435) |
| AT3-1484 19 nt Target #1: | 5'-UCCUCUGAACACUAUUAUC-3' | (SEQ ID NO: 2668) |
| AT3-1484 19 nt Target #2: | 5'-UUCCUCUGAACACUAUUAU-3' | (SEQ ID NO: 3052) |
| AT3-1484 19 nt Target #3: | 5'-GUUCCUCUGAACACUAUUA-3' | (SEQ ID NO: 3436) |
| AT3-1485 19 nt Target #1: | 5'-CCUCUGAACACUAUUAUCU-3' | (SEQ ID NO: 2669) |
| AT3-1485 19 nt Target #2: | 5'-UCCUCUGAACACUAUUAUC-3' | (SEQ ID NO: 3053) |
| AT3-1485 19 nt Target #3: | 5'-UUCCUCUGAACACUAUUAU-3' | (SEQ ID NO: 3437) |
| AT3-1486 19 nt Target #1: | 5'-CUCUGAACACUAUUAUCUU-3' | (SEQ ID NO: 2670) |
| AT3-1486 19 nt Target #2: | 5'-CCUCUGAACACUAUUAUCU-3' | (SEQ ID NO: 3054) |
| AT3-1486 19 nt Target #3: | 5'-UCCUCUGAACACUAUUAUC-3' | (SEQ ID NO: 3438) |
| AT3-1488 19 nt Target #1: | 5'-CUGAACACUAUUAUCUUCA-3' | (SEQ ID NO: 2671) |
| AT3-1488 19 nt Target #2: | 5'-UCUGAACACUAUUAUCUUC-3' | (SEQ ID NO: 3055) |
| AT3-1488 19 nt Target #3: | 5'-CUCUGAACACUAUUAUCUU-3' | (SEQ ID NO: 3439) |
| AT3-1493 19 nt Target #1: | 5'-CACUAUUAUCUUCAUGGGC-3' | (SEQ ID NO: 2672) |
| AT3-1493 19 nt Target #2: | 5'-ACACUAUUAUCUUCAUGGG-3' | (SEQ ID NO: 3056) |
| AT3-1493 19 nt Target #3: | 5'-AACACUAUUAUCUUCAUGG-3' | (SEQ ID NO: 3440) |
| AT3-1584 19 nt Target #1: | 5'-AGAAGUAAAAUAAAUACA-3' | (SEQ ID NO: 2673) |
| AT3-1584 19 nt Target #2: | 5'-CAGAAGUAAAAUAAAUAC-3' | (SEQ ID NO: 3057) |
| AT3-1584 19 nt Target #3: | 5'-ACAGAAGUAAAAUAAAUA-3' | (SEQ ID NO: 3441) |

TABLE 6-continued

DsiRNA Component 19 Nucleotide Target Sequences in AT3 mRNA

| | | |
|---|---|---|
| AT3-1585 19 nt Target #1: | 5'-GAAGUAAAAAUAAAUACAA-3' | (SEQ ID NO: 2674) |
| AT3-1585 19 nt Target #2: | 5'-AGAAGUAAAAAUAAAUACA-3' | (SEQ ID NO: 3058) |
| AT3-1585 19 nt Target #3: | 5'-CAGAAGUAAAAAUAAAUAC-3' | (SEQ ID NO: 3442) |
| AT3-m78 19 nt Target #1: | 5'-GGUGAGAUAUAAGACAUAA-3' | (SEQ ID NO: 2675) |
| AT3-m78 19 nt Target #2: | 5'-UGGUGAGAUAUAAGACAUA-3' | (SEQ ID NO: 3059) |
| AT3-m78 19 nt Target #3: | 5'-GUGGUGAGAUAUAAGACAU-3' | (SEQ ID NO: 3443) |
| AT3-m634 19 nt Target #1: | 5'-AGCAGCUGAUGGAGGUUUU-3' | (SEQ ID NO: 2676) |
| AT3-m634 19 nt Target #2: | 5'-AAGCAGCUGAUGGAGGUUU-3' | (SEQ ID NO: 3060) |
| AT3-m634 19 nt Target #3: | 5'-CAAGCAGCUGAUGGAGGUU-3' | (SEQ ID NO: 3444) |
| AT3-m642 19 nt Target #1: | 5'-AUGGAGGUUUUUAAAUUUG-3' | (SEQ ID NO: 2677) |
| AT3-m642 19 nt Target #2: | 5'-GAUGGAGGUUUUUAAAUUU-3' | (SEQ ID NO: 3061) |
| AT3-m642 19 nt Target #3: | 5'-UGAUGGAGGUUUUUAAAUU-3' | (SEQ ID NO: 3445) |
| AT3-m1574 19 nt Target #1: | 5'-GGAAGUUGCACUGAACACU-3' | (SEQ ID NO: 2678) |
| AT3-m1574 19 nt Target #2: | 5'-GGGAAGUUGCACUGAACAC-3' | (SEQ ID NO: 3062) |
| AT3-m1574 19 nt Target #3: | 5'-AGGGAAGUUGCACUGAACA-3' | (SEQ ID NO: 3446) |
| AT3-m1577 19 nt Target #1: | 5'-AGUUGCACUGAACACUAUU-3' | (SEQ ID NO: 2679) |
| AT3-m1577 19 nt Target #2: | 5'-AAGUUGCACUGAACACUAU-3' | (SEQ ID NO: 3063) |
| AT3-m1577 19 nt Target #3: | 5'-GAAGUUGCACUGAACACUA-3' | (SEQ ID NO: 3447) |
| AT3-m1579 19 nt Target #1: | 5'-UUGCACUGAACACUAUUAU-3' | (SEQ ID NO: 2680) |
| AT3-m1579 19 nt Target #2: | 5'-GUUGCACUGAACACUAUUA-3' | (SEQ ID NO: 3064) |
| AT3-m1579 19 nt Target #3: | 5'-AGUUGCACUGAACACUAUU-3' | (SEQ ID NO: 3448) |
| AT3-m1664 19 nt Target #1: | 5'-CUUUGGUGUUUGUGAAUAG-3' | (SEQ ID NO: 2681) |
| AT3-m1664 19 nt Target #2: | 5'-ACUUUGGUGUUUGUGAAUA-3' | (SEQ ID NO: 3065) |
| AT3-m1664 19 nt Target #3: | 5'-UACUUUGGUGUUUGUGAAU-3' | (SEQ ID NO: 3449) |
| AT3-m1668 19 nt Target #1: | 5'-GGUGUUUGUGAAUAGAAGU-3' | (SEQ ID NO: 2682) |
| AT3-m1668 19 nt Target #2: | 5'-UGGUGUUUGUGAAUAGAAG-3' | (SEQ ID NO: 3066) |
| AT3-m1668 19 nt Target #3: | 5'-UUGGUGUUUGUGAAUAGAA-3' | (SEQ ID NO: 3450) |
| AT3-m1669 19 nt Target #1: | 5'-GUGUUUGUGAAUAGAAGUA-3' | (SEQ ID NO: 2683) |
| AT3-m1669 19 nt Target #2: | 5'-GGUGUUUGUGAAUAGAAGU-3' | (SEQ ID NO: 3067) |
| AT3-m1669 19 nt Target #3: | 5'-UGGUGUUUGUGAAUAGAAG-3' | (SEQ ID NO: 3451) |
| AT3-m1670 19 nt Target #1: | 5'-UGUUUGUGAAUAGAAGUAA-3' | (SEQ ID NO: 2684) |
| AT3-m1670 19 nt Target #2: | 5'-GUGUUUGUGAAUAGAAGUA-3' | (SEQ ID NO: 3068) |
| AT3-m1670 19 nt Target #3: | 5'-GGUGUUUGUGAAUAGAAGU-3' | (SEQ ID NO: 3452) |
| AT3-m1671 19 nt Target #1: | 5'-GUUUGUGAAUAGAAGUAAA-3' | (SEQ ID NO: 2685) |
| AT3-m1671 19 nt Target #2: | 5'-UGUUUGUGAAUAGAAGUAA-3' | (SEQ ID NO: 3069) |
| AT3-m1671 19 nt Target #3: | 5'-GUGUUUGUGAAUAGAAGUA-3' | (SEQ ID NO: 3453) |
| AT3-m1675 19 nt Target #1: | 5'-GUGAAUAGAAGUAAAAAUA-3' | (SEQ ID NO: 2686) |
| AT3-m1675 19 nt Target #2: | 5'-UGUGAAUAGAAGUAAAAAU-3' | (SEQ ID NO: 3070) |
| AT3-m1675 19 nt Target #3: | 5'-UUGUGAAUAGAAGUAAAAA-3' | (SEQ ID NO: 3454) |

TABLE 6-continued

DsiRNA Component 19 Nucleotide Target Sequences in AT3 mRNA

| | | |
|---|---|---|
| AT3-m1949 19 nt Target #1: | 5'-AAGAGGUAAAUAUAUUACU-3' | (SEQ ID NO: 2687) |
| AT3-m1949 19 nt Target #2: | 5'-CAAGAGGUAAAUAUAUUAC-3' | (SEQ ID NO: 3071) |
| AT3-m1949 19 nt Target #3: | 5'-ACAAGAGGUAAAUAUAUUA-3' | (SEQ ID NO: 3455) |
| AT3-m2166 19 nt Target #1: | 5'-AGAAAUGCAUUUUUAUACA-3' | (SEQ ID NO: 2688) |
| AT3-m2166 19 nt Target #2: | 5'-GAGAAAUGCAUUUUUAUAC-3' | (SEQ ID NO: 3072) |
| AT3-m2166 19 nt Target #3: | 5'-AGAGAAAUGCAUUUUUAUA-3' | (SEQ ID NO: 3456) |

Within Tables 2, 3, and 5 above, underlined residues indicate 2'-O-methyl residues, UPPER CASE indicates ribonucleotides, and lower case denotes deoxyribonucleotides. The DsiRNA agents of Tables 2 and 3 above are 25/27mer agents possessing a blunt end. The structures and/or modification patterning of the agents of Tables 2 and 3 above can be readily adapted to the above generic sequence structures, e.g., the 3' overhang of the second strand can be extended or contracted, 2'-O-methylation of the second strand can be expanded towards the 5' end of the second strand, optionally at alternating sites, etc. Such further modifications are optional, as 25/27mer DsiRNAs with such modifications can also be readily designed from the above DsiRNA agents and are also expected to be functional inhibitors of AT3 expression. Similarly, the 27mer "blunt/blunt" DsiRNA structures and/or modification patterns of the agents of Table 5 above can also be readily adapted to the above generic sequence structures, e.g., for application of modification patterning of the antisense strand to such structures and/or adaptation of such sequences to the above generic structures.

In certain embodiments, 27mer DsiRNAs possessing independent strand lengths each of 27 nucleotides are designed and synthesized for targeting of the same sites within the AT3 transcript as the asymmetric "25/27" structures shown in Tables 2 and 3 herein. Exemplary "27/27" DsiRNAs are optionally designed with a "blunt/blunt" structure as shown for the DsiRNAs of Table 5 above.

In certain embodiments, the dsRNA agents of the invention require, e.g., at least 15, at least 16, at least 17, at least 18, at least 19, at least 20, at least 21, at least 22, at least 23, at least 24, at least 25 or at least 26 residues of the first strand to be complementary to corresponding residues of the second strand. In certain related embodiments, these first strand residues complementary to corresponding residues of the second strand are optionally consecutive residues.

By definition, "sufficiently complementary" (contrasted with, e.g., "100% complementary") allows for one or more mismatches to exist between a dsRNA of the invention and the target RNA or cDNA sequence (e.g., AT3 mRNA), provided that the dsRNA possesses complementarity sufficient to trigger the destruction of the target RNA by the RNAi machinery (e.g., the RISC complex) or process. In certain embodiments, a "sufficiently complementary" dsRNA of the invention can harbor one, two, three or even four or more mismatches between the dsRNA sequence and the target RNA or cDNA sequence (e.g., in certain such embodiments, the antisense strand of the dsRNA harbors one, two, three, four, five or even six or more mismatches when aligned with the target RNA or cDNA sequence). Additional consideration of the preferred location of such mismatches within certain dsRNAs of the instant invention is considered in greater detail below.

As used herein "DsiRNAmm" refers to a DisRNA having a "mismatch tolerant region" containing one, two, three or four mismatched base pairs of the duplex formed by the sense and antisense strands of the DsiRNA, where such mismatches are positioned within the DsiRNA at a location(s) lying between (and thus not including) the two terminal base pairs of either end of the DsiRNA. The mismatched base pairs are located within a "mismatch-tolerant region" which is defined herein with respect to the location of the projected Ago2 cut site of the corresponding target nucleic acid. The mismatch tolerant region is located "upstream of" the projected Ago2 cut site of the target strand. "Upstream" in this context will be understood as the 5'-most portion of the DsiRNAmm duplex, where 5' refers to the orientation of the sense strand of the DsiRNA duplex. Therefore, the mismatch tolerant region is upstream of the base on the sense (passenger) strand that corresponds to the projected Ago2 cut site of the target nucleic acid (see FIG. 1); alternatively, when referring to the antisense (guide) strand of the DsiRNAmm, the mismatch tolerant region can also be described as positioned downstream of the base that is complementary to the projected Ago2 cut site of the target nucleic acid, that is, the 3'-most portion of the antisense strand of the DsiRNAmm (where position 1 of the antisense strand is the 5' terminal nucleotide of the antisense strand, see FIG. 1).

In one embodiment, for example with numbering as depicted in FIG. 1, the mismatch tolerant region is positioned between and including base pairs 3-9 when numbered from the nucleotide starting at the 5' end of the sense strand of the duplex. Therefore, a DsiRNAmm of the invention possesses a single mismatched base pair at any one of positions 3, 4, 5, 6, 7, 8 or 9 of the sense strand of a right-hand extended DsiRNA (where position 1 is the 5' terminal nucleotide of the sense strand and position 9 is the nucleotide residue of the sense strand that is immediately 5' of the projected Ago2 cut site of the target AT3 RNA sequence corresponding to the sense strand sequence). In certain embodiments, for a DsiRNAmm that possesses a mismatched base pair nucleotide at any of positions 3, 4, 5, 6, 7, 8 or 9 of the sense strand, the corresponding mismatched base pair nucleotide of the antisense strand not only forms a mismatched base pair with the DsiRNAmm sense strand sequence, but also forms a mismatched base pair with a DsiRNAmm target AT3 RNA sequence (thus, complementarity between the antisense strand sequence and the sense strand sequence is disrupted at the mismatched base pair within the DsiRNAmm, and complementarity is similarly disrupted between the antisense strand sequence of the DsiRNAmm and the target AT3 RNA sequence). In alternative embodiments, the mismatch base pair nucleotide of the antisense strand of a DsiRNAmm only form a mismatched base pair with a corresponding nucleotide of the sense strand sequence of the DsiRNAmm, yet base pairs with its corresponding target AT3 RNA sequence nucleotide (thus, complementarity between the antisense strand sequence and the sense strand sequence is disrupted at the mismatched base pair within the DsiRNAmm, yet complementarity is maintained between the antisense strand sequence of the DsiRNAmm and the target AT3 RNA sequence).

A DsiRNAmm of the invention that possesses a single mismatched base pair within the mismatch-tolerant region (mismatch region) as described above (e.g., a DsiRNAmm harboring a mismatched nucleotide residue at any one of positions 3, 4, 5, 6, 7, 8 or 9 of the sense strand) can further include one, two or even three additional mismatched base pairs. In preferred embodiments, these one, two or three additional mismatched base pairs of the DsiRNAmm occur at position(s) 3, 4, 5, 6, 7, 8 and/or 9 of the sense strand (and at corresponding residues of the antisense strand). In one embodiment where one additional mismatched base pair is present within a DsiRNAmm, the two mismatched base pairs of the sense strand can occur, e.g., at nucleotides of both position 4 and position 6 of the sense strand (with mismatch also occurring at corresponding nucleotide residues of the antisense strand).

In DsiRNAmm agents possessing two mismatched base pairs, mismatches can occur consecutively (e.g., at consecutive positions along the sense strand nucleotide sequence). Alternatively, nucleotides of the sense strand that form mismatched base pairs with the antisense strand sequence can be interspersed by nucleotides that base pair with the antisense strand sequence (e.g., for a DsiRNAmm possessing mismatched nucleotides at positions 3 and 6, but not at positions 4 and 5, the mismatched residues of sense strand positions 3 and 6 are interspersed by two nucleotides that form matched base pairs with corresponding residues of the antisense strand). For example, two residues of the sense strand (located within the mismatch-tolerant region of the sense strand) that form mismatched base pairs with the corresponding antisense strand sequence can occur with zero, one, two, three, four or five matched base pairs located between these mismatched base pairs.

For certain DsiRNAmm agents possessing three mismatched base pairs, mismatches can occur consecutively (e.g., in a triplet along the sense strand nucleotide sequence). Alternatively, nucleotides of the sense strand that form mismatched base pairs with the antisense strand sequence can be interspersed by nucleotides that form matched base pairs with the antisense strand sequence (e.g., for a DsiRNAmm possessing mismatched nucleotides at positions 3, 4 and 8, but not at positions 5, 6 and 7, the mismatched residues of sense strand positions 3 and 4 are adjacent to one another, while the mismatched residues of sense strand positions 4 and 8 are interspersed by three nucleotides that form matched base pairs with corresponding residues of the antisense strand). For example, three residues of the sense strand (located within the mismatch-tolerant region of the sense strand) that form mismatched base pairs with the corresponding antisense strand sequence can occur with zero, one, two, three or four matched base pairs located between any two of these mismatched base pairs.

For certain DsiRNAmm agents possessing four mismatched base pairs, mismatches can occur consecutively (e.g., in a quadruplet along the sense strand nucleotide sequence). Alternatively, nucleotides of the sense strand that form mismatched base pairs with the antisense strand sequence can be interspersed by nucleotides that form matched base pairs with the antisense strand sequence (e.g., for a DsiRNAmm possessing mismatched nucleotides at positions 3, 5, 7 and 8, but not at positions 4 and 6, the mismatched residues of sense strand positions 7 and 8 are adjacent to one another, while the mismatched residues of sense strand positions 3 and 5 are interspersed by one nucleotide that forms a matched base pair with the corresponding residue of the antisense strand—similarly, the mismatched residues of sense strand positions 5 and 7 are also interspersed by one nucleotide that forms a matched base pair with the corresponding residue of the antisense strand). For example, four residues of the sense strand (located within the mismatch-tolerant region of the sense strand) that form mismatched base pairs with the corresponding antisense strand sequence can occur with zero, one, two or three matched base pairs located between any two of these mismatched base pairs.

In another embodiment, for example with numbering also as depicted in FIG. 1, a DsiRNAmm of the invention comprises a mismatch tolerant region which possesses a single mismatched base pair nucleotide at any one of positions 17, 18, 19, 20, 21, 22 or 23 of the antisense strand of the DsiRNA (where position 1 is the 5' terminal nucleotide of the antisense strand and position 17 is the nucleotide residue of the antisense strand that is immediately 3' (downstream) in the antisense strand of the projected Ago2 cut site of the target AT3 RNA sequence sufficiently complementary to the antisense strand sequence). In certain embodiments, for a DsiRNAmm that possesses a mismatched base pair nucleotide at any of positions 17, 18, 19, 20, 21, 22 or 23 of the antisense strand with respect to the sense strand of the DsiRNAmm, the mismatched base pair nucleotide of the antisense strand not only forms a mismatched base pair with the DsiRNAmm sense strand sequence, but also forms a mismatched base pair with a DsiRNAmm target AT3 RNA sequence (thus, complementarity between the antisense strand sequence and the sense strand sequence is disrupted at the mismatched base pair within the DsiRNAmm, and complementarity is similarly disrupted between the antisense strand sequence of the DsiRNAmm and the target AT3 RNA sequence). In alternative embodiments, the mismatch base pair nucleotide of the antisense strand of a DsiRNAmm only forms a mismatched base pair with a corresponding nucleotide of the sense strand sequence of the DsiRNAmm, yet base pairs with its corresponding target AT3 RNA sequence nucleotide (thus, complementarity between the antisense strand sequence and the sense strand sequence is disrupted at the mismatched base pair within the DsiRNAmm, yet complementarity is maintained between the antisense strand sequence of the DsiRNAmm and the target AT3 RNA sequence).

A DsiRNAmm of the invention that possesses a single mismatched base pair within the mismatch-tolerant region as described above (e.g., a DsiRNAmm harboring a mismatched nucleotide residue at positions 17, 18, 19, 20, 21, 22 or 23 of the antisense strand) can further include one, two or even three additional mismatched base pairs. In preferred embodiments, these one, two or three additional mismatched base pairs of the DsiRNAmm occur at position(s) 17, 18, 19, 20, 21, 22 and/or 23 of the antisense strand (and at corresponding residues of the sense strand). In one embodiment where one additional mismatched base pair is present within a DsiRNAmm, the two mismatched base pairs of the antisense strand can occur, e.g., at nucleotides of both position 18 and position 20 of the antisense strand (with mismatch also occurring at corresponding nucleotide residues of the sense strand).

In DsiRNAmm agents possessing two mismatched base pairs, mismatches can occur consecutively (e.g., at consecutive positions along the antisense strand nucleotide sequence). Alternatively, nucleotides of the antisense strand that form mismatched base pairs with the sense strand sequence can be interspersed by nucleotides that base pair with the sense strand sequence (e.g., for a DsiRNAmm possessing mismatched nucleotides at positions 17 and 20, but not at positions 18 and 19, the mismatched residues of antisense strand positions 17 and 20 are interspersed by two nucleotides that form matched base pairs with corresponding residues of the sense strand). For example, two residues of the antisense strand (located within the mismatch-tolerant region of the sense strand) that form mismatched base pairs with the corresponding sense strand sequence can occur with zero, one, two, three, four, five, six or seven matched base pairs located between these mismatched base pairs.

For certain DsiRNAmm agents possessing three mismatched base pairs, mismatches can occur consecutively (e.g., in a triplet along the antisense strand nucleotide sequence). Alternatively, nucleotides of the antisense strand that form mismatched base pairs with the sense strand sequence can be interspersed by nucleotides that form matched base pairs with the sense strand sequence (e.g., for a DsiRNAmm possessing mismatched nucleotides at positions 17, 18 and 22, but not at positions 19, 20 and 21, the mismatched residues of antisense strand positions 17 and 18 are adjacent to one another, while the mismatched residues of antisense strand positions 18 and 122 are interspersed by three nucleotides that form matched base pairs with corresponding residues of the sense strand). For example, three residues of the antisense strand (located within the mismatch-tolerant region of the antisense strand) that form mismatched base pairs with the corresponding sense strand sequence can occur with zero, one, two, three, four, five or six matched base pairs located between any two of these mismatched base pairs.

For certain DsiRNAmm agents possessing four mismatched base pairs, mismatches can occur consecutively (e.g., in a quadruplet along the antisense strand nucleotide sequence). Alternatively, nucleotides of the antisense strand that form mismatched base pairs with the sense strand sequence can be interspersed by nucleotides that form matched base pairs with the sense strand sequence (e.g., for a DsiRNAmm possessing mismatched nucleotides at positions 18, 20, 22 and 23, but not at positions 19 and 21, the mismatched residues of antisense strand positions 22 and 23 are adjacent to one another, while the mismatched residues of antisense strand positions 18 and 20 are interspersed by one nucleotide that forms a matched base pair with the corresponding residue of the sense strand—similarly, the mismatched residues of antisense strand positions 20 and 22 are also interspersed by one nucleotide that forms a matched base pair with the corresponding residue of the sense strand). For example, four residues of the antisense strand (located within the mismatch-tolerant region of the antisense strand) that form mismatched base pairs with the corresponding sense strand sequence can occur with zero, one, two, three, four or five matched base pairs located between any two of these mismatched base pairs.

For reasons of clarity, the location(s) of mismatched nucleotide residues within the above DsiRNAmm agents are numbered in reference to the 5' terminal residue of either sense or antisense strands of the DsiRNAmm. The numbering of positions located within the mismatch-tolerant region (mismatch region) of the antisense strand can shift with variations in the proximity of the 5' terminus of the sense or antisense strand to the projected Ago2 cleavage site. Thus, the location(s) of preferred mismatch sites within either antisense strand or sense strand can also be identified as the permissible proximity of such mismatches to the projected Ago2 cut site. Accordingly, in one preferred embodiment, the position of a mismatch nucleotide of the sense strand of a DsiRNAmm is the nucleotide residue of the sense strand that is located immediately 5' (upstream) of the projected Ago2 cleavage site of the corresponding target AT3 RNA sequence. In other preferred embodiments, a mismatch nucleotide of the sense strand of a DsiRNAmm is positioned at the nucleotide residue of the sense strand that is located two nucleotides 5' (upstream) of the projected Ago2 cleavage site, three nucleotides 5' (upstream) of the projected Ago2 cleavage site, four nucleotides 5' (upstream) of the projected Ago2 cleavage site, five nucleotides 5' (upstream) of the projected Ago2 cleavage site, six nucleotides 5' (upstream) of the projected Ago2 cleavage site, seven nucleotides 5' (upstream) of the projected Ago2 cleavage site, eight nucleotides 5' (upstream) of the projected Ago2 cleavage site, or nine nucleotides 5' (upstream) of the projected Ago2 cleavage site.

Exemplary single mismatch-containing 25/27mer DsiRNAs (DsiRNAmm) include the following structures (such mismatch-containing structures may also be incorporated into other exemplary DsiRNA structures shown herein).

wherein "X"=RNA, "D"=DNA and "M"=Nucleic acid residues (RNA, DNA or non-natural or modified nucleic acids) that do not base pair (hydrogen bond) with corresponding "M" residues of otherwise complementary strand when strands are annealed. Any of the residues of such agents can optionally be 2'-O-methyl RNA monomers—alternating positioning of 2'-O-methyl RNA monomers that commences from the 3'-terminal residue of the bottom (second) strand, as shown above, can also be used in the above DsiRNAmm agents. For the above mismatch structures, the top strand is the sense strand, and the bottom strand is the antisense strand.

In certain embodiments, a DsiRNA of the invention can contain mismatches that exist in reference to the target AT3 RNA sequence yet do not necessarily exist as mismatched base pairs within the two strands of the DsiRNA—thus, a DsiRNA can possess perfect complementarity between first and second strands of a DsiRNA, yet still possess mismatched residues in reference to a target AT3 RNA (which, in certain embodiments, may be advantageous in promoting efficacy and/or potency and/or duration of effect). In certain embodiments, where mismatches occur between antisense strand and target AT3 RNA sequence, the position of a mismatch is located within the antisense strand at a position(s) that corresponds to a sequence of the sense strand located 5' of the projected Ago2 cut site of the target region—e.g., antisense strand residue(s) positioned within the antisense strand to the 3' of the antisense residue which is complementary to the projected Ago2 cut site of the target sequence.

Exemplary 25/27mer DsiRNAs that harbor a single mismatched residue in reference to target sequences include the following structures.

```
Target RNA Sequence:        5'-...AXXXXXXXXXXXXXXXXXXXX...-3'
DsiRNAmm Sense Strand:      5'-XXXXXXXXXXXXXXXXXXXXXXXDD-3'
DsiRNAmm Antisense Strand:  3'-EXXXXXXXXXXXXXXXXXXXXXXXXXX-5'

Target RNA Sequence:        5'-...XAXXXXXXXXXXXXXXXXXXX...-3'
DsiRNAmm Sense Strand:      5'-XXXXXXXXXXXXXXXXXXXXXXXDD-3'
DsiRNAmm Antisense Strand:  3'-XEXXXXXXXXXXXXXXXXXXXXXXXXX-5'

Target RNA Sequence:        5'-...AXXXXXXXXXXXXXXXXXXXX...-3'
DsiRNAmm Sense Strand:      5'-BXXXXXXXXXXXXXXXXXXXXXXXDD-3'
DsiRNAmm Antisense Strand:  3'-XXEXXXXXXXXXXXXXXXXXXXXXXXX-5'

Target RNA Sequence:        5'-...XAXXXXXXXXXXXXXXXXXXX...-3'
DsiRNAmm Sense Strand:      5'-XBXXXXXXXXXXXXXXXXXXXXXXDD-3'
DsiRNAmm Antisense Strand:  3'-XXXEXXXXXXXXXXXXXXXXXXXXXXX-5'

Target RNA Sequence:        5'-...XXAXXXXXXXXXXXXXXXXXX...-3'
DsiRNAmm Sense Strand:      5'-XXBXXXXXXXXXXXXXXXXXXXXXDD-3'
DsiRNAmm Antisense Strand:  3'-XXXXEXXXXXXXXXXXXXXXXXXXXXX-5'

Target RNA Sequence:        5'-...XXXAXXXXXXXXXXXXXXXXX...-3'
DsiRNAmm Sense Strand:      5'-XXXBXXXXXXXXXXXXXXXXXXXXDD-3'
DsiRNAmm Antisense Strand:  3'-XXXXXEXXXXXXXXXXXXXXXXXXXXX-5'

Target RNA Sequence:        5'-...XXXXAXXXXXXXXXXXXXXXX...-3'
DsiRNAmm Sense Strand:      5'-XXXXBXXXXXXXXXXXXXXXXXXXDD-3'
DsiRNAmm Antisense Strand:  3'-XXXXXXEXXXXXXXXXXXXXXXXXXXX-5'

Target RNA Sequence:        5'-...XXXXXAXXXXXXXXXXXXXXX...-3'
DsiRNAmm Sense Strand:      5'-XXXXXBXXXXXXXXXXXXXXXXXXDD-3'
DsiRNAmm Antisense Strand:  3'-XXXXXXXEXXXXXXXXXXXXXXXXXXX-5'

Target RNA Sequence:        5'-...XXXXXXAXXXXXXXXXXXXXX...-3'
DsiRNAmm Sense Strand:      5'-XXXXXXBXXXXXXXXXXXXXXXXXDD-3'
DsiRNAmm Antisense Strand:  3'-XXXXXXXXEXXXXXXXXXXXXXXXXXX-5'

Target RNA Sequence:        5'-...XXXXXXXAXXXXXXXXXXXXX...-3'
DsiRNAmm Sense Strand:      5'-XXXXXXXBXXXXXXXXXXXXXXXXDD-3'
DsiRNAmm Antisense Strand:  3'-XXXXXXXXXEXXXXXXXXXXXXXXXXX-5'

Target RNA Sequence:        5'-...XXXXXXXXAXXXXXXXXXXXX...-3'
DsiRNAmm Sense Strand:      5'-XXXXXXXXBXXXXXXXXXXXXXXXDD-3'
DsiRNAmm Antisense Strand:  3'-XXXXXXXXXXEXXXXXXXXXXXXXXXX-5'
``` wherein "X"=RNA, "D"=DNA and "E"=Nucleic acid residues (RNA, DNA or non-natural or modified nucleic acids) that do not base pair (hydrogen bond) with corresponding "A" RNA residues of otherwise complementary (target) strand when strands are annealed, yet optionally do base pair with corresponding "B" residues ("B" residues are also RNA, DNA or non-natural or modified nucleic acids). Any of the residues of such agents can optionally be 2'-O-methyl RNA monomers—alternating positioning of 2'-O-methyl RNA monomers that commences from the 3'-terminal residue of the bottom (second) strand, as shown above, can also be used in the above DsiRNA agents.

In certain embodiments, the guide strand of a dsRNA of the invention that is sufficiently complementary to a target RNA (e.g., mRNA) along at least 19 nucleotides of the target gene sequence to reduce target gene expression is not perfectly complementary to the at least 19 nucleotide long target gene sequence. Rather, it is appreciated that the guide strand of a dsRNA of the invention that is sufficiently complementary to a target mRNA along at least 19 nucleotides of a target RNA sequence to reduce target gene expression can have one, two, three, or even four or more nucleotides that are mismatched with the 19 nucleotide or longer target strand sequence. Thus, for a 19 nucleotide target RNA sequence, the guide strand of a dsRNA of the invention can be sufficiently complementary to the target RNA sequence to reduce target gene levels while possessing, e.g., only 15/19, 16/19, 17/19 or 18/19 matched nucleotide residues between guide strand and target RNA sequence.

In addition to the above-exemplified structures, dsRNAs of the invention can also possess one, two or three additional residues that form further mismatches with the target AT3 RNA sequence. Such mismatches can be consecutive, or can be interspersed by nucleotides that form matched base pairs with the target AT3 RNA sequence. Where interspersed by nucleotides that form matched base pairs, mismatched residues can be spaced apart from each other within a single strand at an interval of one, two, three, four, five, six, seven or even eight base paired nucleotides between such mismatch-forming residues.

As for the above-described DsiRNAmm agents, a preferred location within dsRNAs (e.g., DsiRNAs) for antisense strand nucleotides that form mismatched base pairs with target AT3 RNA sequence (yet may or may not form mismatches with corresponding sense strand nucleotides) is within the antisense strand region that is located 3' (downstream) of the antisense strand sequence which is complementary to the projected Ago2 cut site of the DsiRNA (e.g., in FIG. 1, the region of the antisense strand which is 3' of the projected Ago2 cut site is preferred for mismatch-forming residues and happens to be located at positions 17-23 of the antisense strand for the 25/27mer agent shown in FIG. 1). Thus, in one embodiment, the position of a mismatch nucleotide (in relation to the target AT3 RNA sequence) of the antisense strand of a DsiRNAmm is the nucleotide residue of the antisense strand that is located immediately 3' (downstream) within the antisense strand sequence of the projected Ago2 cleavage site of the corresponding target AT3 RNA sequence. In other preferred embodiments, a mismatch nucleotide of the antisense strand of a DsiRNAmm (in relation to the target AT3 RNA sequence) is positioned at the nucleotide residue of the antisense strand that is located two nucleotides 3' (downstream) of the corresponding projected Ago2 cleavage site, three nucleotides 3' (downstream) of the corresponding projected Ago2 cleavage site, four nucleotides 3' (downstream) of the corresponding projected Ago2 cleavage site, five nucleotides 3' (downstream) of the corresponding projected Ago2 cleavage site, six nucleotides 3' (downstream) of the projected Ago2 cleavage site, seven nucleotides 3' (downstream) of the projected Ago2 cleavage site, eight nucleotides 3' (downstream) of the projected Ago2 cleavage site, or nine nucleotides 3' (downstream) of the projected Ago2 cleavage site.

In dsRNA agents possessing two mismatch-forming nucleotides of the antisense strand (where mismatch-forming nucleotides are mismatch forming in relation to target AT3 RNA sequence), mismatches can occur consecutively (e.g., at consecutive positions along the antisense strand nucleotide sequence). Alternatively, nucleotides of the antisense strand that form mismatched base pairs with the target AT3 RNA sequence can be interspersed by nucleotides that base pair with the target AT3 RNA sequence (e.g., for a DsiRNA possessing mismatch-forming nucleotides at positions 17 and 20 (starting from the 5' terminus (position 1) of the antisense strand of the 25/27mer agent shown in FIG. 1), but not at positions 18 and 19, the mismatched residues of sense strand positions 17 and 20 are interspersed by two nucleotides that form matched base pairs with corresponding residues of the target AT3 RNA sequence). For example, two residues of the antisense strand (located within the mismatch-tolerant region of the antisense strand) that form mismatched base pairs with the corresponding target AT3 RNA sequence can occur with zero, one, two, three, four or five matched base pairs (with respect to target AT3 RNA sequence) located between these mismatch-forming base pairs.

For certain dsRNAs possessing three mismatch-forming base pairs (mismatch-forming with respect to target AT3 RNA sequence), mismatch-forming nucleotides can occur consecutively (e.g., in a triplet along the antisense strand nucleotide sequence). Alternatively, nucleotides of the antisense strand that form mismatched base pairs with the target AT3 RNA sequence can be interspersed by nucleotides that form matched base pairs with the target AT3 RNA sequence (e.g., for a DsiRNA possessing mismatched nucleotides at positions 17, 18 and 22, but not at positions 19, 20 and 21, the mismatch-forming residues of antisense strand positions 17 and 18 are adjacent to one another, while the mismatch-forming residues of antisense strand positions 18 and 22 are interspersed by three nucleotides that form matched base pairs with corresponding residues of the target AT3 RNA). For example, three residues of the antisense strand (located within the mismatch-tolerant region of the antisense strand) that form mismatched base pairs with the corresponding target AT3 RNA sequence can occur with zero, one, two, three or four matched base pairs located between any two of these mismatch-forming base pairs.

For certain dsRNAs possessing four mismatch-forming base pairs (mismatch-forming with respect to target AT3 RNA sequence), mismatch-forming nucleotides can occur consecutively (e.g., in a quadruplet along the sense strand nucleotide sequence). Alternatively, nucleotides of the antisense strand that form mismatched base pairs with the target AT3 RNA sequence can be interspersed by nucleotides that form matched base pairs with the target AT3 RNA sequence (e.g., for a DsiRNA possessing mismatch-forming nucleotides at positions 17, 19, 21 and 22, but not at positions 18 and 20, the mismatch-forming residues of antisense strand positions 21 and 22 are adjacent to one another, while the mismatch-forming residues of antisense strand positions 17 and 19 are interspersed by one nucleotide that forms a matched base pair with the corresponding residue of the target AT3 RNA sequence—similarly, the mismatch-forming residues of antisense strand positions 19 and 21 are also interspersed by one nucleotide that forms a matched base pair with the corresponding residue of the target AT3 RNA sequence). For example, four residues of the antisense strand (located within the mismatch-tolerant region of the antisense strand) that form mismatched base pairs with the corresponding target AT3 RNA sequence can occur with zero, one, two or three matched base pairs located between any two of these mismatch-forming base pairs.

The above DsiRNAmm and other dsRNA structures are described in order to exemplify certain structures of DsiRNAmm and dsRNA agents. Design of the above DsiRNAmm and dsRNA structures can be adapted to generate, e.g., DsiRNAmm forms of other DsiRNA structures shown infra. As exemplified above, dsRNAs can also be designed that possess single mismatches (or two, three or four mismatches) between the antisense strand of the dsRNA and a target sequence, yet optionally can retain perfect complementarity between sense and antisense strand sequences of a dsRNA.

It is further noted that the dsRNA agents exemplified infra can also possess insertion/deletion (in/del) structures within their double-stranded and/or target AT3 RNA-aligned structures. Accordingly, the dsRNAs of the invention can be designed to possess in/del variations in, e.g., antisense strand sequence as compared to target AT3 RNA sequence and/or antisense strand sequence as compared to sense strand sequence, with preferred location(s) for placement of such in/del nucleotides corresponding to those locations described above for positioning of mismatched and/or mismatch-forming base pairs.

It is also noted that the DsiRNAs of the instant invention can tolerate mismatches within the 3'-terminal region of the sense strand/5'-terminal region of the antisense strand, as this region is modeled to be processed by Dicer and liberated from the guide strand sequence that loads into RISC. Exemplary DsiRNA structures of the invention that harbor such mismatches include the following:

```
Target RNA Sequence:     5'-...XXXXXXXXXXXXXXXXXXXXHXXX...-3'
DsiRNA Sense Strand:     5'-XXXXXXXXXXXXXXXXXXXIXDD-3'
DsiRNA Antisense Strand: 3'-XXXXXXXXXXXXXXXXXXXXXJXXX-5'
```

-continued

```
Target RNA Sequence:      5'-...XXXXXXXXXXXXXXXXXXXXXXHXX...-3'
DsiRNA Sense Strand:      5'-XXXXXXXXXXXXXXXXXXXXXXIDD-3'
DsiRNA Antisense Strand:  3'-XXXXXXXXXXXXXXXXXXXXXXXJXX-5'

Target RNA Sequence:      5'-...XXXXXXXXXXXXXXXXXXXXXXHX...-3'
DsiRNA Sense Strand:      5'-XXXXXXXXXXXXXXXXXXXXXXID-3'
DsiRNA Antisense Strand:  3'-XXXXXXXXXXXXXXXXXXXXXXXJX-5'

Target RNA Sequence:      5'-...XXXXXXXXXXXXXXXXXXXXXXH...-3'
DsiRNA Sense Strand:      5'-XXXXXXXXXXXXXXXXXXXXXXDI-3'
DsiRNA Antisense Strand:  3'-XXXXXXXXXXXXXXXXXXXXXXXJ-5'
``` wherein "X"=RNA, "D"=DNA and "I" and "J"=Nucleic acid residues (RNA, DNA or non-natural or modified nucleic acids) that do not base pair (hydrogen bond) with one another, yet optionally "J" is complementary to target RNA sequence nucleotide "H". Any of the residues of such agents can optionally be 2'-O-methyl RNA monomers—alternating positioning of 2'-O-methyl RNA monomers that commences from the 3'-terminal residue of the bottom (second) strand, as shown above—or any of the above-described methylation patterns—can also be used in the above DsiRNA agents. The above mismatches can also be combined within the DsiRNAs of the instant invention.

In the below structures, such mismatches are introduced within the asymmetric AT3-145 DsiRNA (newly-introduced mismatch residues are italicized):

AT3-145 25/27mer DsiRNA, mismatch position=19 of sense strand (from 5'-terminus)

```
5'-UGUAUUCCAAUGUGAUAG$^A$AACUgt-3'  (SEQ ID NO: 3460)
3'-GUACAUAAGGUUACACUAUC$_C$UUGACA-5' (SEQ ID NO: 4)
```

Optionally, the mismatched 'A' residue of position 19 of the sense strand is alternatively 'U' or 'C'.

AT3-145 25/27mer DsiRNA, mismatch position=20 of sense strand (from 5'-terminus)

```
5'-UGUAUUCCAAUGUGAUAGG$^U$ACUgt-3'  (SEQ ID NO:3461)
3'-GUACAUAAGGUUACACUAUCC$_U$UGACA-5' (SEQ ID NO:4)
```

Optionally, the mismatched 'U' residue of position 20 of the sense strand is alternatively 'C' or 'G'.

AT3-145 25/27mer DsiRNA, mismatch position=21 of sense strand (from 5'-terminus)

```
5'-UGUAUUCCAAUGUGAUAGGA$^U$CUgt-3'  (SEQ ID NO:3462)
3'-GUACAUAAGGUUACACUAUCCU$_U$GACA-5' (SEQ ID NO:4)
```

Optionally, the mismatched 'U' residue of position 21 of the sense strand is alternatively 'G' or 'C'.

AT3-145 25/27mer DsiRNA, mismatch position=22 of sense strand (from 5'-terminus)

```
5'-UGUAUUCCAAUGUGAUAGGAA$^U$Ugt-3'  (SEQ ID NO:3463)
3'-GUACAUAAGGUUACACUAUCCUU$_G$ACA-5' (SEQ ID NO:4)
```

Optionally, the mismatched 'U' residue of position 22 of the sense strand is alternatively 'A' or 'G'.

AT3-145 25/27mer DsiRNA, mismatch position=23 of sense strand (from 5'-terminus)

```
5'-UGUAUUCCAAUGUGAUAGGAAC$^A$gt-3'  (SEQ ID NO:3464)
3'-GUACAUAAGGUUACACUAUCCUUG$_A$CA-5' (SEQ ID NO:4)
```

Optionally, the mismatched 'A' residue of position 23 of the sense strand is alternatively 'C' or 'G'.

AT3-145 25/27mer DsiRNA, mismatch position=24 of sense strand (from 5'-terminus)

```
5'-UGUAUUCCAAUGUGAUAGGAACU$^t$t-3'  (SEQ ID NO:3465)
3'-GUACAUAAGGUUACACUAUCCUUGA$_C$A-5' (SEQ ID NO:4)
```

Optionally, the mismatched 't' residue of position 24 of the sense strand is alternatively 'a' or 'c'.

AT3-145 25/27mer DsiRNA, mismatch position=25 of sense strand (from 5'-terminus)

```
5'-UGUAUUCCAAUGUGAUAGGAACUg$^a$-3'  (SEQ ID NO:3466)
3'-GUACAUAAGGUUACACUAUCCUUGAC$_A$-5' (SEQ ID NO:4)
```

Optionally, the mismatched 'a' residue of position 25 of the sense strand is alternatively 'c' 'g'.

AT3-145 25/27mer DsiRNA, mismatch position=1 of antisense strand (from 5'-terminus)

```
5'-UGUAUUCCAAUGUGAUAGGAACUg$^t$-3'  (SEQ ID NO:388)
3'-GUACAUAAGGUUACACUAUCCUUGAC$_U$-5' (SEQ ID NO:3467)
```

Optionally, the mismatched 'U' residue of position 1 of the antisense strand is alternatively 'G' or 'C'.

AT3-145 25/27mer DsiRNA, mismatch position=2 of antisense strand (from 5'-terminus)

```
5'-UGUAUUCCAAUGUGAUAGGAACU$^g$t-3'  (SEQ ID NO: 388)
3'-GUACAUAAGGUUACACUAUCCUUGA$_A$A-5' (SEQ ID NO: 3468)
```

Optionally, the mismatched 'A' residue of position 2 of the antisense strand is alternatively 'U' or 'G'.

AT3-145 25/27mer DsiRNA, mismatch position=3 of antisense strand (from 5'-terminus)

```
5'-UGUAUUCCAAUGUGAUAGGAACᵁgt-3'   (SEQ ID NO: 388)

3'-GUACAUAAGGUUACACUAUCCUUG_UCA-5'   (SEQ ID NO: 3469)
```

Optionally, the mismatched 'U' residue of position 3 of the antisense strand is alternatively 'C' or 'G'.
AT3-145 25/27mer DsiRNA, mismatch position=4 of antisense strand (from 5'-terminus)

```
5'-UGUAUUCCAAUGUGAUAGGAAᶜUgt-3'   (SEQ ID NO: 388)

3'-GUACAUAAGGUUACACUAUCCUU_AACA-5'   (SEQ ID NO: 3470)
```

Optionally, the mismatched 'A' residue of position 4 of the antisense strand is alternatively 'U' or 'C'.
AT3-145 25/27mer DsiRNA, mismatch position=5 of antisense strand (from 5'-terminus)

```
5'-UGUAUUCCAAUGUGAUAGGAᴬCUgt-3'   (SEQ ID NO: 388)

3'-GUACAUAAGGUUACACUAUCCU_AGACA-5'   (SEQ ID NO: 3471)
```

Optionally, the mismatched 'A' residue of position 5 of the antisense strand is alternatively 'C' or 'G'.
AT3-145 25/27mer DsiRNA, mismatch position=6 of antisense strand (from 5'-terminus)

```
5'-UGUAUUCCAAUGUGAUAGGᴬACUgt-3'   (SEQ ID NO: 388)

3'-GUACAUAAGGUUACACUAUCC_AUGACA-5'   (SEQ ID NO: 3472)
```

Optionally, the mismatched 'A' residue of position 6 of the antisense strand is alternatively 'C' or 'G'.
AT3-145 25/27mer DsiRNA, mismatch position=7 of antisense strand (from 5'-terminus)

```
5'-UGUAUUCCAAUGUGAUAGᴳAACUgt-3'   (SEQ ID NO: 388)

3'-GUACAUAAGGUUACACUAUC_UUUGACA-5'   (SEQ ID NO: 3473)
```

Optionally, the mismatched 'U' residue of position 7 of the antisense strand is alternatively 'A' or 'G'.
As another example, in the below structures, such mismatches are introduced within the asymmetric AT3-179 DsiRNA (newly-introduced mismatch residues are italicized):
AT3-179 25/27mer DsiRNA, mismatch position=19 of sense strand (from 5'-terminus)

```
5'-AAAAAGGAAGGUUUAUCUᴬUUGUcc-3'   (SEQ ID NO: 3474)

3'-CCUUUUUCCUUCCAAAUAGA_AACAGG-5'   (SEQ ID NO: 13)
```

Optionally, the mismatched 'A' residue of position 19 of the sense strand is alternatively 'C' or 'G'.
AT3-179 25/27mer DsiRNA, mismatch position=20 of sense strand (from 5'-terminus)

```
5'-AAAAAGGAAGGUUUAUCUUᴬUGUcc-3'   (SEQ ID NO: 3475)

3'-CCUUUUUCCUUCCAAAUAGAA_ACAGG-5'   (SEQ ID NO: 13)
```

Optionally, the mismatched 'A' residue of position 20 of the sense strand is alternatively 'C' or 'G'.
AT3-179 25/27mer DsiRNA, mismatch position=21 of sense strand (from 5'-terminus)

```
5'-AAAAAGGAAGGUUUAUCUUUᴬGUcc-3'   (SEQ ID NO: 3476)

3'-CCUUUUUCCUUCCAAAUAGAAA_CAGG-5'   (SEQ ID NO: 13)
```

Optionally, the mismatched 'A' residue of position 21 of the sense strand is alternatively 'C' or 'G'.
AT3-179 25/27mer DsiRNA, mismatch position=22 of sense strand (from 5'-terminus)

```
5'-AAAAAGGAAGGUUUAUCUUUUᵁUcc-3'   (SEQ ID NO: 3477)

3'-CCUUUUUCCUUCCAAAUAGAAAA_CAGG-5'   (SEQ ID NO: 13)
```

Optionally, the mismatched 'U' residue of position 22 of the sense strand is alternatively 'A' or 'C'.
AT3-179 25/27mer DsiRNA, mismatch position=23 of sense strand (from 5'-terminus)

```
5'-AAAAAGGAAGGUUUAUCUUUUGᴬcc-3'   (SEQ ID NO: 3478)

3'-CCUUUUUCCUUCCAAAUAGAAAAC_AGG-5'   (SEQ ID NO: 13)
```

Optionally, the mismatched 'A' residue of position 23 of the sense strand is alternatively 'C' or 'G'.
AT3-179 25/27mer DsiRNA, mismatch position=24 of sense strand (from 5'-terminus)

```
5'-AAAAAGGAAGGUUUAUCUUUUGUᵗc-3'   (SEQ ID NO: 3479)

3'-CCUUUUUCCUUCCAAAUAGAAAACA_GG-5'   (SEQ ID NO: 13)
```

Optionally, the mismatched 't' residue of position 24 of the sense strand is alternatively 'a' or 'g'.
AT3-179 25/27mer DsiRNA, mismatch position=25 of sense strand (from 5'-terminus)

```
5'-AAAAAGGAAGGUUUAUCUUUUGUcᵃ-3'   (SEQ ID NO: 3480)

3'-CCUUUUUCCUUCCAAAUAGAAAACAG_G-5'   (SEQ ID NO: 13)
```

Optionally, the mismatched 'a' residue of position 25 of the sense strand is alternatively 't' or 'g'.

AT3-179 25/27mer DsiRNA, mismatch position=1 of antisense strand (from 5'-terminus)

```
5'-AAAAAGGAAGGUUUAUCUUUUGUc^C-3'  (SEQ ID NO: 397)

3'-CCUUUUUCCUUCCAAAUAGAAAACAG_U-5'  (SEQ ID NO: 3481)
```

Optionally, the mismatched 'U' residue of position 1 of the antisense strand is alternatively 'A' or 'C'.

AT3-179 25/27mer DsiRNA, mismatch position=2 of antisense strand (from 5'-terminus)

```
5'-AAAAAGGAAGGUUUAUCUUUUGU^Cc-3'  (SEQ ID NO: 397)

3'-CCUUUUUCCUUCCAAAUAGAAAACA_AG-5'  (SEQ ID NO: 3482)
```

Optionally, the mismatched 'A' residue of position 2 of the antisense strand is alternatively 'U' or 'C'.

AT3-179 25/27mer DsiRNA, mismatch position=3 of antisense strand (from 5'-terminus)

```
5'-AAAAAGGAAGGUUUAUCUUUUG^Ucc-3'  (SEQ ID NO: 397)
3'-CCUUUUUCCUUCCAAAUAGAAAAC_UGG-5'  (SEQ ID NO: 3483)
```

Optionally, the mismatched 'U' residue of position 3 of the antisense strand is alternatively 'C' or 'G'.

AT3-179 25/27mer DsiRNA, mismatch position=4 of antisense strand (from 5'-terminus)

```
5'-AAAAAGGAAGGUUUAUCUUUU^GUcc-3'  (SEQ ID NO: 397)
3'-CCUUUUUCCUUCCAAAUAGAAAA_AGG-5'  (SEQ ID NO: 3484)
```

Optionally, the mismatched 'A' residue of position 4 of the antisense strand is alternatively 'U' or 'G'.

AT3-179 25/27mer DsiRNA, mismatch position=5 of antisense strand (from 5'-terminus)

```
5'-AAAAAGGAAGGUUUAUCUUU^UGUcc-3'  (SEQ ID NO: 397)
3'-CCUUUUUCCUUCCAAAUAGAAA_UCAGG-5'  (SEQ ID NO: 3485)
```

Optionally, the mismatched 'U' residue of position 5 of the antisense strand is alternatively 'C' or 'G'.

AT3-179 25/27mer DsiRNA, mismatch position=6 of antisense strand (from 5'-terminus)

```
5'-AAAAAGGAAGGUUUAUCUU^UUGUcc-3'  (SEQ ID NO: 397)
3'-CCUUUUUCCUUCCAAAUAGAA_UACAGG-5'  (SEQ ID NO: 3486)
```

Optionally, the mismatched 'U' residue of position 6 of the antisense strand is alternatively 'C' or 'G'.

AT3-179 25/27mer DsiRNA, mismatch position=7 of antisense strand (from 5'-terminus)

```
5'-AAAAAGGAAGGUUUAUCU^UUUGUcc-3'  (SEQ ID NO: 397)
3'-CCUUUUUCCUUCCAAAUAGA_UAACAGG-5'  (SEQ ID NO: 3487)
```

Optionally, the mismatched 'U' residue of position 7 of the antisense strand is alternatively 'C' or 'G'.

As an additional example, in the below structures, such mismatches are introduced within the asymmetric AT3-619 DsiRNA (newly-introduced mismatch residues are italicized):

AT3-619 25/27mer DsiRNA, mismatch position=19 of sense strand (from 5'-terminus)

```
5'-ACUGCCGACUCUAUCGAA^UAGCCaa-3'  (SEQ ID NO: 3488)
3'-CUUGACGGCUGAGAUAGCUU_UUCGGUU-5'  (SEQ ID NO: 121)
```

Optionally, the mismatched 'U' residue of position 19 of the sense strand is alternatively 'C' or 'G'.

AT3-619 25/27mer DsiRNA, mismatch position=20 of sense strand (from 5'-terminus)

```
5'-ACUGCCGACUCUAUCGAAA^UGCCaa-3'  (SEQ ID NO: 3489)
3'-CUUGACGGCUGAGAUAGCUUU_UCGGUU-5'  (SEQ ID NO: 121)
```

Optionally, the mismatched 'U' residue of position 20 of the sense strand is alternatively 'C' or 'G'.

AT3-619 25/27mer DsiRNA, mismatch position=21 of sense strand (from 5'-terminus)

```
5'-ACUGCCGACUCUAUCGAAAA^ACCaa-3'  (SEQ ID NO: 3490)
3'-CUUGACGGCUGAGAUAGCUUUU_CGGUU-5'  (SEQ ID NO: 121)
```

Optionally, the mismatched 'A' residue of position 21 of the sense strand is alternatively 'U' or 'C'.

AT3-619 25/27mer DsiRNA, mismatch position=22 of sense strand (from 5'-terminus)

```
5'-ACUGCCGACUCUAUCGAAAAG^UCaa-3'  (SEQ ID NO: 3491)
3'-CUUGACGGCUGAGAUAGCUUUUC_GGUU-5'  (SEQ ID NO: 121)
```

Optionally, the mismatched 'U' residue of position 22 of the sense strand is alternatively 'A' or 'G'.

AT3-619 25/27mer DsiRNA, mismatch position=23 of sense strand (from 5'-terminus)

```
5'-ACUGCCGACUCUAUCGAAAAGC^Aaa-3'  (SEQ ID NO: 3492)
3'-CUUGACGGCUGAGAUAGCUUUUCG_GUU-5'  (SEQ ID NO: 121)
```

Optionally, the mismatched 'A' residue of position 23 of the sense strand is alternatively 'U' or 'G'.

AT3-619 25/27mer DsiRNA, mismatch position=24 of sense strand (from 5'-terminus)

```
5'-ACUGCCGACUCUAUCGAAAAGCC^ga-3'  (SEQ ID NO: 3493)
3'-CUUGACGGCUGAGAUAGCUUUUCGG_UU-5'  (SEQ ID NO: 121)
```

Optionally, the mismatched 'g' residue of position 24 of the sense strand is alternatively 't' or 'c'.

AT3-619 25/27mer DsiRNA, mismatch position=25 of sense strand (from 5'-terminus)

```
5'-ACUGCCGACUCUAUCGAAAAGCCa^t-3'   (SEQ ID NO: 3494)
3'-CUUGACGGCUGAGAUAGCUUUUCGGU_U-5' (SEQ ID NO: 121)
```

Optionally, the mismatched 't' residue of position 25 of the sense strand is alternatively 'c' or 'g'.

AT3-619 25/27mer DsiRNA, mismatch position=1 of antisense strand (from 5'-terminus)

```
5'-ACUGCCGACUCUAUCGAAAAGCCa^a-3'   (SEQ ID NO: 505)
3'-CUUGACGGCUGAGAUAGCUUUUCGGU_A-5' (SEQ ID NO: 3495)
```

Optionally, the mismatched 'A' residue of position 1 of the antisense strand is alternatively 'G' or 'C'.

AT3-619 25/27mer DsiRNA, mismatch position=2 of antisense strand (from 5'-terminus)

```
5'-ACUGCCGACUCUAUCGAAAAGCC^aa-3'   (SEQ ID NO: 505)
3'-CUUGACGGCUGAGAUAGCUUUUCGG_CU-5' (SEQ ID NO: 3496)
```

Optionally, the mismatched 'C' residue of position 2 of the antisense strand is alternatively 'A' or 'G'.

AT3-619 25/27mer DsiRNA, mismatch position=3 of antisense strand (from 5'-terminus)

```
5'-ACUGCCGACUCUAUCGAAAAGC^Caa-3'   (SEQ ID NO: 505)
3'-CUUGACGGCUGAGAUAGCUUUUCG_UUU-5' (SEQ ID NO: 3497)
```

Optionally, the mismatched 'U' residue of position 3 of the antisense strand is alternatively 'A' or 'C'.

AT3-619 25/27mer DsiRNA, mismatch position=4 of antisense strand (from 5'-terminus)

```
5'-ACUGCCGACUCUAUCGAAAAG^CCaa-3'    (SEQ ID NO: 505)
3'-CUUGACGGCUGAGAUAGCUUUUC_AGUU-5'  (SEQ ID NO: 3498)
```

Optionally, the mismatched 'A' residue of position 4 of the antisense strand is alternatively 'U' or 'C'.

AT3-619 25/27mer DsiRNA, mismatch position=5 of antisense strand (from 5'-terminus)

```
5'-ACUGCCGACUCUAUCGAAAA^GCCaa-3'    (SEQ ID NO: 505)
3'-CUUGACGGCUGAGAUAGCUUUU_UGGUU-5'  (SEQ ID NO: 3499)
```

Optionally, the mismatched 'U' residue of position 5 of the antisense strand is alternatively 'A' or 'G'.

AT3-619 25/27mer DsiRNA, mismatch position=6 of antisense strand (from 5'-terminus)

```
5'-ACUGCCGACUCUAUCGAAA^AGCCaa-3'    (SEQ ID NO: 505)
3'-CUUGACGGCUGAGAUAGCUUU_ACGGUU-5'  (SEQ ID NO: 3500)
```

Optionally, the mismatched 'A' residue of position 6 of the antisense strand is alternatively 'C' or 'G'.

AT3-619 25/27mer DsiRNA, mismatch position=7 of antisense strand (from 5'-terminus)

```
5'-ACUGCCGACUCUAUCGAA^AGCCaa-3'     (SEQ ID NO: 505)
3'-CUUGACGGCUGAGAUAGCUU_AUCGGUU-5'  (SEQ ID NO: 3501)
```

Optionally, the mismatched 'A' residue of position 7 of the antisense strand is alternatively 'C' or 'G'.

As a further example, in the below structures, such mismatches are introduced within the asymmetric AT3-990 DsiRNA (newly-introduced mismatch residues are italicized):

AT3-990 25/27mer DsiRNA, mismatch position=19 of sense strand (from 5'-terminus)

```
5'-AUGAUGUACCAGGAAGGC^UAGUUcc-3'    (SEQ ID NO: 3502)
3'-GAUACUACAUGGUCCUUCCG_UUCAAGG-5'  (SEQ ID NO: 260)
```

Optionally, the mismatched 'U' residue of position 19 of the sense strand is alternatively 'C' or 'G'.

AT3-990 25/27mer DsiRNA, mismatch position=20 of sense strand (from 5'-terminus)

```
5'-AUGAUGUACCAGGAAGGCA^UGUUcc-3'    (SEQ ID NO: 3503)
3'-GAUACUACAUGGUCCUUCCGU_UCAAGG-5'  (SEQ ID NO: 260)
```

Optionally, the mismatched 'U' residue of position 20 of the sense strand is alternatively 'C' or 'G'.

AT3-990 25/27mer DsiRNA, mismatch position=21 of sense strand (from 5'-terminus)

```
5'-AUGAUGUACCAGGAAGGCAA^UUcc-3'     (SEQ ID NO: 3504)
3'-GAUACUACAUGGUCCUUCCGUU_CAAGG-5'  (SEQ ID NO: 260)
```

Optionally, the mismatched 'A' residue of position 21 of the sense strand is alternatively 'U' or 'C'.

AT3-990 25/27mer DsiRNA, mismatch position=22 of sense strand (from 5'-terminus)

```
5'-AUGAUGUACCAGGAAGGCAAG^Ucc-3'     (SEQ ID NO: 3505)
3'-GAUACUACAUGGUCCUUCCGUUC_AAGG-5'  (SEQ ID NO: 260)
```

Optionally, the mismatched 'G' residue of position 22 of the sense strand is alternatively 'A' or 'C'.

AT3-990 25/27mer DsiRNA, mismatch position=23 of sense strand (from 5'-terminus)

```
5'-AUGAUGUACCAGGAAGGCAAGU^Acc-3'    (SEQ ID NO: 3506)
3'-GAUACUACAUGGUCCUUCCGUUCA_AGG-5'  (SEQ ID NO: 260)
```

Optionally, the mismatched 'A' residue of position 23 of the sense strand is alternatively 'C' or 'G'.
AT3-990 25/27mer DsiRNA, mismatch position=24 of sense strand (from 5'-terminus)

```
5'-AUGAUGUACCAGGAAGGCAAGUU^tc-3'    (SEQ ID NO: 3507)
3'-GAUACUACAUGGUCCUUCCGUUCAA_GG-5'  (SEQ ID NO: 260)
```

Optionally, the mismatched 't' residue of position 24 of the sense strand is alternatively 'a' or 'g'.
AT3-990 25/27mer DsiRNA, mismatch position=25 of sense strand (from 5'-terminus)

```
5'-AUGAUGUACCAGGAAGGCAAGUc^a-3'     (SEQ ID NO: 3508)
3'-GAUACUACAUGGUCCUUCCGUUCAAG_G-5'  (SEQ ID NO: 260)
```

Optionally, the mismatched 'a' residue of position 25 of the sense strand is alternatively 't' or 'g'.
AT3-990 25/27mer DsiRNA, mismatch position=1 of antisense strand (from 5'-terminus)

```
5'-AUGAUGUACCAGGAAGGCAAGUUc^c-3'    (SEQ ID NO: 644)
3'-GAUACUACAUGGUCCUUCCGUUCAAG_U-5'  (SEQ ID NO: 3509)
```

Optionally, the mismatched 'U' residue of position 1 of the antisense strand is alternatively 'A' or 'C'.
AT3-990 25/27mer DsiRNA, mismatch position=2 of antisense strand (from 5'-terminus)

```
5'-AUGAUGUACCAGGAAGGCAAGUU^cc-3'    (SEQ ID NO: 644)
3'-GAUACUACAUGGUCCUUCCGUUCAA_AG-5'  (SEQ ID NO: 3510)
```

Optionally, the mismatched 'A' residue of position 2 of the antisense strand is alternatively 'U' or 'C'.
AT3-990 25/27mer DsiRNA, mismatch position=3 of antisense strand (from 5'-terminus)

```
5'-AUGAUGUACCAGGAAGGCAAGU^Ucc-3'    (SEQ ID NO: 644)
3'-GAUACUACAUGGUCCUUCCGUUCA_UGG-5'  (SEQ ID NO: 3511)
```

Optionally, the mismatched 'U' residue of position 3 of the antisense strand is alternatively 'C' or 'G'.
AT3-990 25/27mer DsiRNA, mismatch position=4 of antisense strand (from 5'-terminus)

```
5'-AUGAUGUACCAGGAAGGCAAG^Ucc-3'     (SEQ ID NO: 644)
3'-GAUACUACAUGGUCCUUCCGUUC_CAGG-5'  (SEQ ID NO: 3512)
```

Optionally, the mismatched 'C' residue of position 4 of the antisense strand is alternatively 'U' or 'G'.
AT3-990 25/27mer DsiRNA, mismatch position=5 of antisense strand (from 5'-terminus)

```
5'-AUGAUGUACCAGGAAGGCAA^GUUcc-3'    (SEQ ID NO: 644)
3'-GAUACUACAUGGUCCUUCCGUU_UAAGG-5'  (SEQ ID NO: 3513)
```

Optionally, the mismatched 'U' residue of position 5 of the antisense strand is alternatively 'A' or 'G'.
AT3-990 25/27mer DsiRNA, mismatch position=6 of antisense strand (from 5'-terminus)

```
5'-AUGAUGUACCAGGAAGGCA^AGUUcc-3'    (SEQ ID NO: 644)
3'-GAUACUACAUGGUCCUUCCGU_ACAGG-5'   (SEQ OD NO: 3514)
```

Optionally, the mismatched 'A' residue of position 6 of the antisense strand is alternatively 'C' or 'G'.
AT3-990 25/27mer DsiRNA, mismatch position=7 of antisense strand (from 5'-terminus)

```
5'-AUGAUGUACCAGGAAGGC^AGUUcc-3'     (SEQ ID NO: 644)
3'-GAUACUACAUGGUCCUUCCG_AUCAAGG-5'  (SEQ OD NO: 3515)
```

Optionally, the mismatched 'A' residue of position 7 of the antisense strand is alternatively 'C' or 'G'.

As another example, in the below structures, such mismatches are introduced within the asymmetric AT3-1585 DsiRNA (newly-introduced mismatch residues are italicized):
AT3-1585 25/27mer DsiRNA, mismatch position=19 of sense strand (from 5'-terminus)

```
5'-GAAGUAAAAAUAAAUACA^UACUAct-3'    (SEQ ID NO: 3516)
3'-GUCUUCAUUUUUAUUUAUGU_UGAUGA-5'   (SEQ ID NO: 370)
```

Optionally, the mismatched 'U' residue of position 19 of the sense strand is alternatively 'C' or 'G'.
AT3-1585 25/27mer DsiRNA, mismatch position=20 of sense strand (from 5'-terminus)

```
5'-GAAGUAAAAAUAAAUACAA^UCUAct-3'    (SEQ ID NO: 3517)
3'-GUCUUCAUUUUUAUUUAUGUU_GAUGA-5'   (SEQ ID NO: 370)
```

Optionally, the mismatched 'U' residue of position 20 of the sense strand is alternatively 'C' or 'G'.
AT3-1585 25/27mer DsiRNA, mismatch position=21 of sense strand (from 5'-terminus)

```
5'-GAAGUAAAAAUAAAUACAAA^UAct-3'     (SEQ ID NO: 3518)
3'-GUCUUCAUUUUUAUUUAUGUUU_GAUGA-5'  (SEQ ID NO: 370)
```

Optionally, the mismatched 'A' residue of position 21 of the sense strand is alternatively 'U' or 'G'.
AT3-1585 25/27mer DsiRNA, mismatch position=22 of sense strand (from 5'-terminus)

```
5'-GAAGUAAAAAUAAAUACAAAC^Act-3'     (SEQ ID NO: 3519)
3'-GUCUUCAUUUUUAUUUAUGUUUG_AUGA-5'  (SEQ ID NO: 370)
```

Optionally, the mismatched 'G' residue of position 22 of the sense strand is alternatively 'A' or 'C'.
AT3-1585 25/27mer DsiRNA, mismatch position=23 of sense strand (from 5'-terminus)

```
5'-GAAGUAAAAAUAAAUACAAAC^Uct-3' (SEQ ID NO: 3520)
3'-GUCUUCAUUUUUAUUUAUGUUUGA_UGA-5' (SEQ ID NO: 370)
```

Optionally, the mismatched 'U' residue of position 23 of the sense strand is alternatively 'C' or 'G'.
AT3-1585 25/27mer DsiRNA, mismatch position=24 of sense strand (from 5'-terminus)

```
5'-GAAGUAAAAAUAAAUACAAACUA^t-3' (SEQ ID NO: 3521)
3'-GUCUUCAUUUUUAUUUAUGUUUGAU_GA-5' (SEQ ID NO: 370)
```

Optionally, the mismatched 't' residue of position 24 of the sense strand is alternatively 'a' or 'g'.
AT3-1585 25/27mer DsiRNA, mismatch position=25 of sense strand (from 5'-terminus)

```
5'-GAAGUAAAAAUAAAUACAAACUAc^a-3' (SEQ ID NO: 3522)
3'-GUCUUCAUUUUUAUUUAUGUUUGAUG_A-5' (SEQ ID NO: 370)
```

Optionally, the mismatched 'a' residue of position 25 of the sense strand is alternatively 'c' or 'g'.
AT3-1585 25/27mer DsiRNA, mismatch position=1 of antisense strand (from 5'-terminus)

```
5'-GAAGUAAAAAUAAAUACAAACUAc^t-3' (SEQ ID NO: 754)
3'-GUCUUCAUUUUUAUUUAUGUUUGAUG_U-5' (SEQ ID NO: 3523)
```

Optionally, the mismatched 'U' residue of position 1 of the antisense strand is alternatively 'G' or 'C'.
AT3-1585 25/27mer DsiRNA, mismatch position=2 of antisense strand (from 5'-terminus)

```
5'-GAAGUAAAAAUAAAUACAAACUA^Ct-3' (SEQ ID NO: 754)
3'-GUCUUCAUUUUUAUUUAUGUUUGAU_AA-5' (SEQ ID NO: 3524)
```

Optionally, the mismatched 'A' residue of position 2 of the antisense strand is alternatively 'U' or 'C'.
AT3-1585 25/27mer DsiRNA, mismatch position=3 of antisense strand (from 5'-terminus)

```
5'-GAAGUAAAAAUAAAUACAAACU^Act-3' (SEQ ID NO: 754)
3'-GUCUUCAUUUUUAUUUAUGUUUGA_AGA-5' (SEQ ID NO: 3525)
```

Optionally, the mismatched 'A' residue of position 3 of the antisense strand is alternatively 'C' or 'G'.
AT3-1585 25/27mer DsiRNA, mismatch position=4 of antisense strand (from 5'-terminus)

```
5'-GAAGUAAAAAUAAAUACAAAC^UAct-3' (SEQ ID NO: 754)
3'-GUCUUCAUUUUUAUUUAUGUUUG_CUGA-5' (SEQ ID NO: 3526)
```

Optionally, the mismatched 'C' residue of position 4 of the antisense strand is alternatively 'U' or 'G'.
AT3-1585 25/27mer DsiRNA, mismatch position=5 of antisense strand (from 5'-terminus)

```
5'-GAAGUAAAAAUAAAUACAAA^CUAct-3' (SEQ ID NO: 754)
3'-GUCUUCAUUUUUAUUUAUGUUU_UAUGA-5' (SEQ ID NO: 3527)
```

Optionally, the mismatched 'U' residue of position 5 of the antisense strand is alternatively 'A' or 'C'.
AT3-1585 25/27mer DsiRNA, mismatch position=6 of antisense strand (from 5'-terminus)

```
5'-GAAGUAAAAAUAAAUACAA^ACUAct-3' (SEQ ID NO: 754)
3'-GUCUUCAUUUUUAUUUAUGUU_AGAUGA-5' (SEQ ID NO: 3528)
```

Optionally, the mismatched 'A' residue of position 6 of the antisense strand is alternatively "C" or 'G'.
AT3-1585 25/27mer DsiRNA, mismatch position=7 of antisense strand (from 5'-terminus)

```
5'-GAAGUAAAAAUAAAUACA^AACUAct-3' (SEQ ID NO: 754)
3'-GUCUUCAUUUUUAUUUAUGU_AUGAUGA-5' (SEQ ID NO: 3529)
```

Optionally, the mismatched 'A' residue of position 7 of the antisense strand is alternatively 'C' or 'G'.

For the above oligonucleotide strand sequences, it is contemplated that the sense strand sequence of one depicted duplex can be combined with an antisense strand of another depicted duplex, thereby forming a distinct duplex—in certain instances, such duplexes contain a mismatched residue with respect to the AT3 target transcript sequence, while such sense and antisense strand sequences do not present a mismatch at this residue with respect to one another (e.g., duplexes comprising SEQ ID NOs: 3466 and 3467; SEQ ID NOs: 3465 and 3468; SEQ ID NOs: 3466 and 3469, etc., are contemplated as exemplary of such duplexes).

As noted above, introduction of mismatches can be performed upon any of the DsiRNAs described herein.

The mismatches of such DsiRNA structures can be combined to produce a DsiRNA possessing, e.g., two, three or even four mismatches within the 3'-terminal four to seven nucleotides of the sense strand/5'-terminal four to seven nucleotides of the antisense strand.

Indeed, in view of the flexibility of sequences which can be incorporated into DsiRNAs at the 3'-terminal residues of the sense strand/5'-terminal residues of the antisense strand, in certain embodiments, the sequence requirements of an asymmetric DsiRNA of the instant invention can be represented as the following (minimalist) structure (shown for an exemplary AT3-145 DsiRNA sequence):

```
                                    (SEQ ID NO: 3530)
5'-UGUAUUCCAAUGUGAUAGXXXXXX[X]_n-3'

(SEQ ID NO: 3531)
3'-GUACAUAAGGUUACACUAUCXXXXXX[X]_n-5'
``` where n=1 to 5, 1 to 10, 1 to 20, 1 to 30, 1 to 50, or 1 to 80 or more.

```
AT3-145 mRNA Target:
                                    (SEQ ID NO: 3532)
5'-CAUGUAUUCCAAUGUGAUAGXXXXXXX-3'.
```

The AT3 target site may also be a site which is targeted by one or more of several oligonucleotides whose complementary target sites overlap with a stated target site. For example, for an exemplary AT3-145 DsiRNA, it is noted that certain DsiRNAs targeting overlapping and only slightly offset AT3 sequences could exhibit activity levels similar to that of AT3-145 (e.g., AT3-142, 143, 144, 146, 147 and 148 of Table 2 above). Thus, in certain embodiments, a designated target sequence region might be effectively targeted by a series of DsiRNAs possessing largely overlapping sequences. (E.g., if considering DsiRNAs of the AT3-142 to AT3-148 target site(s), a more encompassing AT3 transcript target sequence might be recited as, e.g., 5'-GGCCAU-GUAUUCCAAUGUGAUAGGAACUGUAAC-3' (SEQ ID NO: 3533), wherein any given DsiRNA (e.g., a DsiRNA selected from AT3-142 to AT3-148) only targets a subsequence within such a sequence region, yet the entire sequence can be considered a viable target for such a series of DsiRNAs).

Additionally and/or alternatively, mismatches within the 3'-terminal seven nucleotides of the sense strand/5'-terminal seven nucleotides of the antisense strand can be combined with mismatches positioned at other mismatch-tolerant positions, as described above.

In view of the present identification of the above-described Dicer substrate agents (DsiRNAs) as inhibitors of AT3 levels via targeting of specific AT3 sequences, it is also recognized that dsRNAs having structures similar to those described herein can also be synthesized which target other sequences within the AT3 sequence of GenBank Accession No. NM_000488.3 (human AT3), or within variants thereof (e.g., target sequences possessing 80% identity, 90% identity, 95% identity, 96% identity, 97% identity, 98% identity, 99% or more identity to a sequence of NM_000488.3).

Anti-AT3 DsiRNA Design/Synthesis

It has been found empirically that longer dsRNA species of from 25 to 35 nucleotides (DsiRNAs) and especially from 25 to 30 nucleotides give unexpectedly effective results in terms of potency and duration of action, as compared to 19-23mer siRNA agents. Without wishing to be bound by the underlying theory of the dsRNA processing mechanism, it is thought that the longer dsRNA species serve as a substrate for the Dicer enzyme in the cytoplasm of a cell. In addition to cleaving the dsRNA of the invention into shorter segments, Dicer is thought to facilitate the incorporation of a single-stranded cleavage product derived from the cleaved dsRNA into the RISC complex that is responsible for the destruction of the cytoplasmic RNA (e.g., AT3 RNA) of or derived from the target gene, AT3 (or other gene associated with an AT3-associated disease or disorder). Prior studies (Rossi et al., U.S. Patent Application No. 2007/0265220) have shown that the cleavability of a dsRNA species (specifically, a DsiRNA agent) by Dicer corresponds with increased potency and duration of action of the dsRNA species.

Certain anti-AT3 DsiRNA agents were selected from a pre-screened population. Design of DsiRNAs can optionally involve use of predictive scoring algorithms that perform in silico assessments of the projected activity/efficacy of a number of possible DsiRNA agents spanning a region of sequence. Information regarding the design of such scoring algorithms can be found, e.g., in Gong et al. (*BMC Bioinformatics* 2006, 7:516), though a more recent "v4.3" algorithm represents a theoretically improved algorithm relative to siRNA scoring algorithms previously available in the art. (E.g., "v3" and "v4" scoring algorithms are machine learning algorithms that are not reliant upon any biases in human sequence. In addition, the "v3" and "v4" algorithms derive from data sets that are many-fold larger than that from which an older "v2" algorithm such as that described in Gong et al. derives.)

The first and second oligonucleotides of the DsiRNA agents of the instant invention are not required to be completely complementary. In fact, in one embodiment, the 3'-terminus of the sense strand contains one or more mismatches. In one aspect, two mismatches are incorporated at the 3' terminus of the sense strand. In another embodiment, the DsiRNA of the invention is a double stranded RNA molecule containing two RNA oligonucleotides each of which is 27 nucleotides in length and, when annealed to each other, have blunt ends and a two nucleotide mismatch on the 3'-terminus of the sense strand (the 5'-terminus of the antisense strand). The use of mismatches or decreased thermodynamic stability (specifically at the 3'-sense/5'-antisense position) has been proposed to facilitate or favor entry of the antisense strand into RISC (Schwarz et al., 2003, Cell 115: 199-208; Khvorova et al., 2003, Cell 115: 209-216), presumably by affecting some rate-limiting unwinding steps that occur with entry of the siRNA into RISC. Thus, terminal base composition has been included in design algorithms for selecting active 21mer siRNA duplexes (Ui-Tei et al., 2004, *Nucleic Acids Res* 32: 936-948; Reynolds et al., 2004, *Nat Biotechnol* 22: 326-330). With Dicer cleavage of the dsRNA of this embodiment, the small end-terminal sequence which contains the mismatches will either be left unpaired with the antisense strand (become part of a 3'-overhang) or be cleaved entirely off the final 21-mer siRNA. These "mismatches", therefore, do not persist as mismatches in the final RNA component of RISC. The finding that base mismatches or destabilization of segments at the 3'-end of the sense strand of Dicer substrate improved the potency of synthetic duplexes in RNAi, presumably by facilitating processing by Dicer, was a surprising finding of past works describing the design and use of 25-30mer dsRNAs (also termed "DsiRNAs" herein; Rossi et al., U.S. Patent Application Nos. 2005/0277610, 2005/0244858 and 2007/0265220).

Modification of Anti-AT3 dsRNAs

One major factor that inhibits the effect of double stranded RNAs ("dsRNAs") is the degradation of dsRNAs (e.g., siRNAs and DsiRNAs) by nucleases. A 3'-exonuclease is the primary nuclease activity present in serum and modification of the 3'-ends of antisense DNA oligonucleotides is crucial to prevent degradation (Eder et al., 1991, *Antisense Res Dev*, 1: 141-151). An RNase-T family nuclease has been identified called ERI-1 which has 3' to 5' exonuclease activity that is involved in regulation and degradation of siRNAs (Kennedy et al., 2004, *Nature* 427: 645-649; Hong et al., 2005, *Biochem J*, 390: 675-679). This gene is also known as Thex1 (NM_026067) in mice or THEX1 (NM_153332) in humans and is involved in degradation of histone mRNA; it also mediates degradation of 3'-overhangs in siRNAs, but does not degrade duplex RNA (Yang et al., 2006, *J Biol Chem*, 281: 30447-30454). It is therefore reasonable to expect that 3'-end-stabilization of dsRNAs, including the DsiRNAs of the instant invention, will improve stability.

XRN1 (NM_019001) is a 5' to 3' exonuclease that resides in P-bodies and has been implicated in degradation of mRNA targeted by miRNA (Rehwinkel et al., 2005, *RNA* 11: 1640-1647) and may also be responsible for completing degradation initiated by internal cleavage as directed by a siRNA. XRN2 (NM_012255) is a distinct 5' to 3' exonuclease that is involved in nuclear RNA processing.

RNase A is a major endonuclease activity in mammals that degrades RNAs. It is specific for ssRNA and cleaves at the 3'-end of pyrimidine bases. SiRNA degradation products consistent with RNase A cleavage can be detected by mass spectrometry after incubation in serum (Turner et al., 2007, *Mol Biosyst* 3: 43-50). The 3'-overhangs enhance the susceptibility of siRNAs to RNase degradation. Depletion of RNase A from serum reduces degradation of siRNAs; this degradation does show some sequence preference and is worse for sequences having poly A/U sequence on the ends (Haupenthal et al., 2006 *Biochem Pharmacol* 71: 702-710). This suggests the possibility that lower stability regions of the duplex may "breathe" and offer transient single-stranded species available for degradation by RNase A. RNase A inhibitors can be added to serum and improve siRNA longevity and potency (Haupenthal et al., 2007, *Int J. Cancer* 121: 206-210).

In 21mers, phosphorothioate or boranophosphate modifications directly stabilize the internucleoside phosphate linkage. Boranophosphate modified RNAs are highly nuclease resistant, potent as silencing agents, and are relatively non-toxic. Boranophosphate modified RNAs cannot be manufactured using standard chemical synthesis methods and instead are made by in vitro transcription (IVT) (Hall et al., 2004, *Nucleic Acids Res* 32: 5991-6000; Hall et al., 2006, *Nucleic Acids Res* 34: 2773-2781). Phosphorothioate (PS) modifications can be easily placed in the RNA duplex at any desired position and can be made using standard chemical synthesis methods. The PS modification shows dose-dependent toxicity, so most investigators have recommended limited incorporation in siRNAs, favoring the 3'-ends where protection from nucleases is most important (Harborth et al., 2003, *Antisense Nucleic Acid Drug Dev* 13: 83-105; Chiu and Rana, 2003, *Mol Cell* 10: 549-561; Braasch et al., 2003, *Biochemistry* 42: 7967-7975; Amarzguioui et al., 2003, *Nucleic Acids Research* 31: 589-595). More extensive PS modification can be compatible with potent RNAi activity; however, use of sugar modifications (such as 2'-O-methyl RNA) may be superior (Choung et al., 2006, *Biochem Biophys Res Commun* 342: 919-927).

A variety of substitutions can be placed at the 2'-position of the ribose which generally increases duplex stability ($T_m$) and can greatly improve nuclease resistance. 2'-O-methyl RNA is a naturally occurring modification found in mammalian ribosomal RNAs and transfer RNAs. 2'-O-methyl modification in siRNAs is known, but the precise position of modified bases within the duplex is important to retain potency and complete substitution of 2'-O-methyl RNA for RNA will inactivate the siRNA. For example, a pattern that employs alternating 2'-O-methyl bases can have potency equivalent to unmodified RNA and is quite stable in serum (Choung et al., 2006, *Biochem Biophys Res Commun* 342: 919-927; Czauderna et al., 2003, *Nucleic Acids Research* 31: 2705-2716).

The 2'-fluoro (2'-F) modification is also compatible with dsRNA (e.g., siRNA and DsiRNA) function; it is most commonly placed at pyrimidine sites (due to reagent cost and availability) and can be combined with 2'-O-methyl modification at purine positions; 2'-F purines are available and can also be used. Heavily modified duplexes of this kind can be potent triggers of RNAi in vitro (Allerson et al., 2005, *J Med Chem* 48: 901-904; Prakash et al., 2005, *J Med Chem* 48: 4247-4253; Kraynack and Baker, 2006, *RNA* 12: 163-176) and can improve performance and extend duration of action when used in vivo (Morrissey et al., 2005, *Hepatology* 41: 1349-1356; Morrissey et al., 2005, *Nat Biotechnol* 23: 1002-1007). A highly potent, nuclease stable, blunt 19mer duplex containing alternative 2'-F and 2'-O-Me bases is taught by Allerson. In this design, alternating 2'-O-Me residues are positioned in an identical pattern to that employed by Czauderna, however the remaining RNA residues are converted to 2'-F modified bases. A highly potent, nuclease resistant siRNA employed by Morrissey employed a highly potent, nuclease resistant siRNA in vivo. In addition to 2'-O-Me RNA and 2'-F RNA, this duplex includes DNA, RNA, inverted abasic residues, and a 3'-terminal PS internucleoside linkage. While extensive modification has certain benefits, more limited modification of the duplex can also improve in vivo performance and is both simpler and less costly to manufacture. Soutschek et al. (2004, *Nature* 432: 173-178) employed a duplex in vivo and was mostly RNA with two 2'-O-Me RNA bases and limited 3'-terminal PS internucleoside linkages.

Locked nucleic acids (LNAs) are a different class of 2'-modification that can be used to stabilize dsRNA (e.g., siRNA and DsiRNA). Patterns of LNA incorporation that retain potency are more restricted than 2'-O-methyl or 2'-F bases, so limited modification is preferred (Braasch et al., 2003, *Biochemistry* 42: 7967-7975; Grunweller et al., 2003, *Nucleic Acids Res* 31: 3185-3193; Elmen et al., 2005, *Nucleic Acids Res* 33: 439-447). Even with limited incorporation, the use of LNA modifications can improve dsRNA performance in vivo and may also alter or improve off target effect profiles (Mook et al., 2007, *Mol Cancer Ther* 6: 833-843).

Synthetic nucleic acids introduced into cells or live animals can be recognized as "foreign" and trigger an immune response. Immune stimulation constitutes a major class of off-target effects which can dramatically change experimental results and even lead to cell death. The innate immune system includes a collection of receptor molecules that specifically interact with DNA and RNA that mediate these responses, some of which are located in the cytoplasm and some of which reside in endosomes (Marques and Williams, 2005, *Nat Biotechnol* 23: 1399-1405; Schlee et al., 2006, *Mol Ther* 14: 463-470). Delivery of siRNAs by cationic lipids or liposomes exposes the siRNA to both cytoplasmic and endosomal compartments, maximizing the risk for triggering a type 1 interferon (IFN) response both in vitro and in vivo (Morrissey et al., 2005, *Nat Biotechnol* 23: 1002-1007; Sioud and Sorensen, 2003, *Biochem Biophys Res Commun* 312: 1220-1225; Sioud, 2005, *J Mol Biol* 348: 1079-1090; Ma et al., 2005, *Biochem Biophys Res Commun* 330: 755-759). RNAs transcribed within the cell are less immunogenic (Robbins et al., 2006, *Nat Biotechnol* 24: 566-571) and synthetic RNAs that are immunogenic when delivered using lipid-based methods can evade immune stimulation when introduced unto cells by mechanical means, even in vivo (Heidel et al., 2004, *Nat Biotechnol* 22: 1579-1582). However, lipid based delivery methods are convenient, effective, and widely used. Some general strategy to prevent immune responses is needed, especially for in vivo application where all cell types are present and the risk of generating an immune response is highest. Use of chemically modified RNAs may solve most or even all of these problems.

In certain embodiments, modifications can be included in the anti-AT3 dsRNA agents of the present invention so long as the modification does not prevent the dsRNA agent from possessing AT3 inhibitory activity. In one embodiment, one or more modifications are made that enhance Dicer processing of the DsiRNA agent (an assay for determining Dicer processing of a DsiRNA is described elsewhere herein). In a second embodiment, one or more modifications are made that result in more effective AT3 inhibition (as described herein, AT3 inhibition/AT3 inhibitory activity of a dsRNA can be assayed via art-recognized methods for determining RNA levels, or for determining AT3 polypeptide levels, should such levels be assessed in lieu of or in addition to assessment of, e.g., AT3 mRNA levels). In a third embodiment, one or more modifications are made that support greater AT3 inhibitory activity (means of determining AT3 inhibitory activity are described supra). In a fourth embodiment, one or more modifications are made that result in greater potency of AT3 inhibitory activity per each dsRNA agent molecule to be delivered to the cell (potency of AT3 inhibitory activity is described supra). Modifications can be incorporated in the 3'-terminal region, the 5'-terminal region, in both the 3'-terminal and 5'-terminal region or in some instances in various positions within the sequence. With the restrictions noted above in mind, numbers and combinations of modifications can be incorporated into the dsRNA agent. Where multiple modifications are present, they may be the same or different. Modifications to bases, sugar moieties, the phosphate backbone, and their combinations are contemplated. Either 5'-terminus can be phosphorylated.

Examples of modifications contemplated for the phosphate backbone include phosphonates, including methylphosphonate, phosphorothioate, and phosphotriester modifications such as alkylphosphotriesters, and the like. Examples of modifications contemplated for the sugar moiety include 2'-alkyl pyrimidine, such as 2'-O-methyl, 2'-fluoro, amino, and deoxy modifications and the like (see, e.g., Amarzguioui et al., 2003, *Nucleic Acids Research* 31: 589-595). Examples of modifications contemplated for the base groups include abasic sugars, 2-O-alkyl modified pyrimidines, 4-thiouracil, 5-bromouracil, 5-iodouracil, and 5-(3-aminoallyl)-uracil and the like. Locked nucleic acids, or LNA's, could also be incorporated. Many other modifications are known and can be used so long as the above criteria are satisfied. Examples of modifications are also disclosed in U.S. Pat. Nos. 5,684,143, 5,858,988 and 6,291, 438 and in U.S. published patent application No. 2004/0203145 A1. Other modifications are disclosed in Herdewijn (2000, *Antisense Nucleic Acid Drug Dev* 10: 297-310), Eckstein (2000, *Antisense Nucleic Acid Drug Dev* 10: 117-21), Rusckowski et al. (2000, *Antisense Nucleic Acid Drug Dev* 10: 333-345), Stein et al. (2001, *Antisense Nucleic Acid Drug Dev* 11: 317-25); Vorobjev et al. (2001, *Antisense Nucleic Acid Drug Dev* 11: 77-85).

One or more modifications contemplated can be incorporated into either strand. The placement of the modifications in the dsRNA agent can greatly affect the characteristics of the dsRNA agent, including conferring greater potency and stability, reducing toxicity, enhance Dicer processing, and minimizing an immune response. In one embodiment, the antisense strand or the sense strand or both strands have one or more 2'-O-methyl modified nucleotides. In another embodiment, the antisense strand contains 2'-O-methyl modified nucleotides. In another embodiment, the antisense stand contains a 3' overhang that is comprised of 2'-O-methyl modified nucleotides. The antisense strand could also include additional 2'-O-methyl modified nucleotides.

In certain embodiments, the anti-AT3 DsiRNA agent of the invention has several properties which enhance its processing by Dicer. According to such embodiments, the DsiRNA agent has a length sufficient such that it is processed by Dicer to produce an siRNA and at least one of the following properties: (i) the DsiRNA agent is asymmetric, e.g., has a 3' overhang on the sense strand and (ii) the DsiRNA agent has a modified 3' end on the antisense strand to direct orientation of Dicer binding and processing of the dsRNA to an active siRNA. According to these embodiments, the longest strand in the DsiRNA agent comprises 25-30 nucleotides. In one embodiment, the sense strand comprises 25-30 nucleotides and the antisense strand comprises 25-30 nucleotides. Thus, the resulting dsRNA has an overhang on the 3' end of the sense strand. The overhang is 1-4 nucleotides, such as 2 nucleotides. The antisense strand may also have a 5' phosphate.

In certain embodiments, the sense strand of a DsiRNA agent is modified for Dicer processing by suitable modifiers located at the 3' end of the sense strand, i.e., the DsiRNA agent is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for the 2'-deoxyribofuranosyl sugar normally present in dNMPs. Other nucleotide modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). In one embodiment, deoxynucleotides are used as the modifiers. When nucleotide modifiers are utilized, 1-3 nucleotide modifiers, or 2 nucleotide modifiers are substituted for the ribonucleotides on the 3' end of the sense strand. When sterically hindered molecules are utilized, they are attached to the ribonucleotide at the 3' end of the antisense strand. Thus, the length of the strand does not change with the incorporation of the modifiers. In another embodiment, the invention contemplates substituting two DNA bases in the dsRNA to direct the orientation of Dicer processing. In a further invention, two terminal DNA bases are located on the 3' end of the sense strand in place of two ribonucleotides forming a blunt end of the duplex on the 5' end of the antisense strand and the 3' end of the sense strand, and a two-nucleotide RNA overhang is located on the 3'-end of the antisense strand. This is an asymmetric composition with DNA on the blunt end and RNA bases on the overhanging end.

In certain other embodiments, the antisense strand of a DsiRNA agent is modified for Dicer processing by suitable modifiers located at the 3' end of the antisense strand, i.e., the DsiRNA agent is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for the 2'-deoxyribofuranosyl sugar normally present in dNMPs. Other nucleotide modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). In one embodiment, deoxynucleotides are used as the modifiers. When nucleotide modifiers are utilized, 1-3 nucleotide modifiers, or 2 nucleotide modifiers are substituted for the ribonucleotides on the 3' end of the antisense strand. When sterically hindered molecules are utilized, they are attached to the ribonucleotide at the 3' end of the antisense strand. Thus, the length of the strand does not change with the incorporation of the modifiers. In another embodiment, the invention contemplates substituting two DNA bases in the dsRNA to direct the orientation of Dicer processing. In a further invention, two terminal DNA bases are located on the 3' end of the antisense strand in place of two ribonucleotides forming a blunt end of the duplex on the 5' end of the sense strand and the 3' end of the antisense strand, and a two-nucleotide RNA overhang is located on the 3'-end of the sense strand. This is also an asymmetric composition with DNA on the blunt end and RNA bases on the overhanging end.

The sense and antisense strands anneal under biological conditions, such as the conditions found in the cytoplasm of a cell. In addition, a region of one of the sequences, particularly of the antisense strand, of the dsRNA has a sequence length of at least 19 nucleotides, wherein these nucleotides are adjacent to the 3' end of antisense strand and are sufficiently complementary to a nucleotide sequence of the target AT3 RNA.

Additionally, the DsiRNA agent structure can be optimized to ensure that the oligonucleotide segment generated from Dicer's cleavage will be the portion of the oligonucleotide that is most effective in inhibiting gene expression. For example, in one embodiment of the invention, a 27-bp oligonucleotide of the DsiRNA agent structure is synthesized wherein the anticipated 21 to 22-bp segment that will inhibit gene expression is located on the 3'-end of the antisense strand. The remaining bases located on the 5'-end of the antisense strand will be cleaved by Dicer and will be discarded. This cleaved portion can be homologous (i.e., based on the sequence of the target sequence) or non-homologous and added to extend the nucleic acid strand.

US 2007/0265220 discloses that 27mer DsiRNAs showed improved stability in serum over comparable 21mer siRNA compositions, even absent chemical modification. Modifications of DsiRNA agents, such as inclusion of 2'-O-methyl RNA in the antisense strand, in patterns such as detailed above, when coupled with addition of a 5' Phosphate, can improve stability of DsiRNA agents. Addition of 5'-phosphate to all strands in synthetic RNA duplexes may be an inexpensive and physiological method to confer some limited degree of nuclease stability.

The chemical modification patterns of the dsRNA agents of the instant invention are designed to enhance the efficacy of such agents. Accordingly, such modifications are designed to avoid reducing potency of dsRNA agents; to avoid interfering with Dicer processing of DsiRNA agents; to improve stability in biological fluids (reduce nuclease sensitivity) of dsRNA agents; or to block or evade detection by the innate immune system. Such modifications are also designed to avoid being toxic and to avoid increasing the cost or impact the ease of manufacturing the instant dsRNA agents of the invention.

In certain embodiments of the present invention, an anti-AT3 DsiRNA agent has one or more of the following properties: (i) the DsiRNA agent is asymmetric, e.g., has a 3' overhang on the antisense strand and (ii) the DsiRNA agent has a modified 3' end on the sense strand to direct orientation of Dicer binding and processing of the dsRNA to an active siRNA. In one such contemplated embodiment, the longest strand in the dsRNA comprises 25-35 nucleotides (e.g., 25, 26, 27, 28, 29, 30, 31, 32, 33, 34 or 35 nucleotides). In certain such embodiments, the DsiRNA agent is asymmetric such that the sense strand comprises 25-34 nucleotides and the 3' end of the sense strand forms a blunt end with the 5' end of the antisense strand while the antisense strand comprises 26-35 nucleotides and forms an overhang on the 3' end of the antisense strand. In one embodiment, the DsiRNA agent is asymmetric such that the sense strand comprises 25-28 nucleotides and the antisense strand comprises 25-30 nucleotides. Thus, the resulting dsRNA has an overhang on the 3' end of the antisense strand. The overhang is 1-4 nucleotides, for example 2 nucleotides. The sense strand may also have a 5' phosphate.

The DsiRNA agent can also have one or more of the following additional properties: (a) the antisense strand has a right shift from the typical 21mer (e.g., the DsiRNA comprises a length of antisense strand nucleotides that extends to the 5' of a projected Dicer cleavage site within the DsiRNA, with such antisense strand nucleotides base paired with corresponding nucleotides of the sense strand extending 3' of a projected Dicer cleavage site in the sense strand), (b) the strands may not be completely complementary, i.e., the strands may contain simple mismatched base pairs (in certain embodiments, the DsiRNAs of the invention possess 1, 2, 3, 4 or even 5 or more mismatched base pairs, provided that AT3 inhibitory activity of the DsiRNA possessing mismatched base pairs is retained at sufficient levels (e.g., retains at least 50% AT3 inhibitory activity or more, at least 60% AT3 inhibitory activity or more, at least 70% AT3 inhibitory activity or more, at least 80% AT3 inhibitory activity or more, at least 90% AT3 inhibitory activity or more or at least 95% AT3 inhibitory activity or more as compared to a corresponding DsiRNA not possessing mismatched base pairs. In certain embodiments, mismatched base pairs exist between the antisense and sense strands of a DsiRNA. In some embodiments, mismatched base pairs exist (or are predicted to exist) between the antisense strand and the target RNA. In certain embodiments, the presence of a mismatched base pair(s) between an antisense strand residue and a corresponding residue within the target RNA that is located 3' in the target RNA sequence of a projected Ago2 cleavage site retains and may even enhance AT3 inhibitory activity of a DsiRNA of the invention) and (c) base modifications such as locked nucleic acid(s) may be included in the 5' end of the sense strand. A "typical" 21mer siRNA is designed using conventional techniques. In one technique, a variety of sites are commonly tested in parallel or pools containing several distinct siRNA duplexes specific to the same target with the hope that one of the reagents will be effective (Ji et al., 2003, *FEBS Lett* 552: 247-252). Other techniques use design rules and algorithms to increase the likelihood of obtaining active RNAi effector molecules (Schwarz et al., 2003, *Cell* 115: 199-208; Khvorova et al., 2003, *Cell* 115: 209-216; Ui-Tei et al., 2004, *Nucleic Acids Res* 32: 936-948; Reynolds et al., 2004, *Nat Biotechnol* 22: 326-330; Krol et al., 2004, *J Biol Chem* 279: 42230-42239; Yuan et al., 2004, *Nucl Acids Res* 32 (Webserver issue): W130-134; Boese et al., 2005, *Methods Enzymol* 392: 73-96). High throughput selection of siRNA has also been developed (U.S. published patent application No. 2005/0042641 A1). Potential target sites can also be analyzed by secondary structure predictions (Heale et al., 2005, *Nucleic Acids Res* 33(3): e30). This 21mer is then used to design a right shift to include 3-9 additional nucleotides on the 5' end of the 21mer. The sequence of these additional nucleotides is not restricted. In one embodiment, the added ribonucleotides are based on the sequence of the target gene. Even in this embodiment, full complementarity between the target sequence and the antisense siRNA is not required.

The first and second oligonucleotides of a DsiRNA agent of the instant invention are not required to be completely complementary. They only need to be sufficiently complementary to anneal under biological conditions and to provide a substrate for Dicer that produces a siRNA sufficiently complementary to the target sequence. Locked nucleic acids, or LNA's, are well known to a skilled artisan (Elmen et al., 2005, *Nucleic Acids Res* 33: 439-447; Kurreck et al., 2002, *Nucleic Acids Res* 30: 1911-1918; Crinelli et al., 2002, *Nucleic Acids Res* 30: 2435-2443; Braasch and Corey, 2001, *Chem Biol* 8: 1-7; Bondensgaard et al., 2000, *Chemistry* 6: 2687-2695; Wahlestedt et al., 2000, *Proc Natl Acad Sci USA* 97: 5633-5638). In one embodiment, an LNA is incorporated at the 5' terminus of the sense strand. In another embodiment, an LNA is incorporated at the 5' terminus of the sense strand in duplexes designed to include a 3' overhang on the antisense strand.

In certain embodiments, the DsiRNA agent of the instant invention has an asymmetric structure, with the sense strand having a 25-base pair length, and the antisense strand having a 27-base pair length with a 2 base 3'-overhang. In other embodiments, this DsiRNA agent having an asymmetric structure further contains 2 deoxynucleotides at the 3' end of the sense strand in place of two of the ribonucleotides.

Certain DsiRNA agent compositions containing two separate oligonucleotides can be linked by a third structure. The third structure will not block Dicer activity on the DsiRNA agent and will not interfere with the directed destruction of the RNA transcribed from the target gene. In one embodiment, the third structure may be a chemical linking group. Many suitable chemical linking groups are known in the art and can be used. Alternatively, the third structure may be an oligonucleotide that links the two oligonucleotides of the DsiRNA agent in a manner such that a hairpin structure is produced upon annealing of the two oligonucleotides making up the dsRNA composition. The hairpin structure will not block Dicer activity on the DsiRNA agent and will not interfere with the directed destruction of the AT3 RNA.

AT3 cDNA and Polypeptide Sequences

Known human and mouse AT3 cDNA and polypeptide sequences include the following: human AT3 GenBank Accession No. NM_000488.3 and corresponding human AT3 polypeptide sequence GenBank Accession No. NP_000479.1; and mouse wild-type Serpinc1 (referred to as mouse AT3 herein) sequence GenBank Accession No. NM_080844.4 (*Mus musculus* C57BL/6 Serpinc1/AT3) and corresponding mouse Serpinc1/AT3 sequence GenBank Accession No. NP 543120.1.

In Vitro Assay to Assess dsRNA AT3 Inhibitory Activity

An in vitro assay that recapitulates RNAi in a cell-free system can be used to evaluate dsRNA constructs targeting AT3 RNA sequence(s), and thus to assess AT3-specific gene inhibitory activity (also referred to herein as AT3 inhibitory activity) of a dsRNA. The assay comprises the system described by Tuschl et al., 1999, *Genes and Development*, 13, 3191-3197 and Zamore et al., 2000, *Cell*, 101, 25-33 adapted for use with dsRNA (e.g., DsiRNA) agents directed against AT3 RNA. A *Drosophila* extract derived from syncytial blastoderm is used to reconstitute RNAi activity in vitro. Target RNA is generated via in vitro transcription from a selected AT3 expressing plasmid using T7 RNA polymerase or via chemical synthesis. Sense and antisense dsRNA strands (for example, 20 uM each) are annealed by incubation in buffer (such as 100 mM potassium acetate, 30 mM HEPES-KOH, pH 7.4, 2 mM magnesium acetate) for 1 minute at 90° C. followed by 1 hour at 37° C., then diluted in lysis buffer (for example 100 mM potassium acetate, 30 mM HEPES-KOH at pH 7.4, 2 mM magnesium acetate). Annealing can be monitored by gel electrophoresis on an agarose gel in TBE buffer and stained with ethidium bromide. The *Drosophila* lysate is prepared using zero to two-hour-old embryos from Oregon R flies collected on yeasted molasses agar that are dechorionated and lysed. The lysate is centrifuged and the supernatant isolated. The assay comprises a reaction mixture containing 50% lysate [vol/vol], RNA (10-50 pM final concentration), and 10% [vol/vol] lysis buffer containing dsRNA (10 nM final concentration). The reaction mixture also contains 10 mM creatine phosphate, 10 ug/ml creatine phosphokinase, 100 um GTP, 100 uM UTP, 100 uM CTP, 500 uM ATP, 5 mM DTT, 0.1 U/uL RNasin (Promega), and 100 uM of each amino acid. The final concentration of potassium acetate is adjusted to 100 mM. The reactions are pre-assembled on ice and pre-incubated at 25° C. for 10 minutes before adding RNA, then incubated at 25° C. for an additional 60 minutes. Reactions are quenched with 4 volumes of 1.25×Passive Lysis Buffer (Promega). Target RNA cleavage is assayed by RT-PCR analysis or other methods known in the art and are compared to control reactions in which dsRNA is omitted from the reaction. Alternately, internally-labeled target RNA for the assay is prepared by in vitro transcription in the presence of [$\alpha$-$^{32}$P] CTP, passed over a G50 Sephadex column by spin chromatography and used as target RNA without further purification. Optionally, target RNA is 5'-$^{32}$P-end labeled using T4 polynucleotide kinase enzyme. Assays are performed as described above and target RNA and the specific RNA cleavage products generated by RNAi are visualized on an autoradiograph of a gel. The percentage of cleavage is determined by PHOSPHOR IMAGER® (autoradiography) quantitation of bands representing intact control RNA or RNA from control reactions without dsRNA and the cleavage products generated by the assay.

In one embodiment, this assay is used to determine target sites in the AT3 RNA target for dsRNA mediated RNAi cleavage, wherein a plurality of dsRNA constructs are screened for RNAi mediated cleavage of the AT3 RNA target, for example, by analyzing the assay reaction by electrophoresis of labeled target RNA, or by northern blotting, as well as by other methodology well known in the art.

In certain embodiments, a dsRNA of the invention is deemed to possess AT3 inhibitory activity if, e.g., a 50% reduction in AT3 RNA levels is observed in a system, cell, tissue or organism, relative to a suitable control. Additional metes and bounds for determination of AT3 inhibitory activity of a dsRNA of the invention are described supra.

Conjugation and Delivery of Anti-AT3 dsRNA Agents

In certain embodiments, the present invention relates to a method for treating a subject having or at risk of developing a disease or disorder for which inhibition of AT3 is predicted to or has been demonstrated to have therapeutic value (e.g., a blood disease such as hemophilia). In such embodiments, the dsRNA can act as novel therapeutic agents for controlling the disease or disorder for which inhibition of AT3 is predicted to or has been demonstrated to have therapeutic value. The method comprises administering a pharmaceutical composition of the invention to the patient (e.g., human), such that the expression, level and/or activity of an AT3 RNA is reduced. The expression, level and/or activity of a polypeptide encoded by an AT3 RNA might also be reduced by a dsRNA of the instant invention, even where said dsRNA is directed against a non-coding region of the AT3 transcript (e.g., a targeted 5' UTR or 3' UTR sequence). Because of their high specificity, the dsRNAs of the present invention can specifically target AT3 sequences of cells and tissues, optionally even in an allele-specific manner where polymorphic alleles exist within an individual and/or population.

In the treatment of a disease or disorder for which inhibition of AT3 is predicted to or has been demonstrated to have therapeutic value, the dsRNA can be brought into contact with the cells or tissue of a subject, e.g., the cells or tissue of a subject exhibiting disregulation of AT3 and/or otherwise targeted for reduction of AT3 levels. For example, dsRNA substantially identical to all or part of an AT3 RNA sequence may be brought into contact with or introduced into such a cell, either in vivo or in vitro. Similarly, dsRNA substantially identical to all or part of an AT3 RNA sequence may be administered directly to a subject having or at risk of developing a disease or disorder for which inhibition of AT3 is predicted to or has been demonstrated to have therapeutic value.

Therapeutic use of the dsRNA agents of the instant invention can involve use of formulations of dsRNA agents comprising multiple different dsRNA agent sequences. For example, two or more, three or more, four or more, five or more, etc. of the presently described agents can be combined to produce a formulation that, e.g., targets multiple different regions of the AT3 RNA, or that not only target AT3 RNA but also target, e.g., cellular target genes associated with a disease or disorder for which inhibition of AT3 is predicted to or has been demonstrated to have therapeutic value. A dsRNA agent of the instant invention may also be constructed such that either strand of the dsRNA agent independently targets two or more regions of AT3 RNA, or such that one of the strands of the dsRNA agent targets a cellular target gene of AT3 known in the art.

Use of multifunctional dsRNA molecules that target more then one region of a target nucleic acid molecule can also provide potent inhibition of AT3 RNA levels and expression. For example, a single multifunctional dsRNA construct of the invention can target both the AT3-145 and AT3-619 sites simultaneously; additionally and/or alternatively, single or multifunctional agents of the invention can be designed to selectively target one splice variant of AT3 over another.

Thus, the dsRNA agents of the instant invention, individually, or in combination or in conjunction with other drugs, can be used to treat, inhibit, reduce, or prevent a disease or disorder for which inhibition of AT3 is predicted to or has been demonstrated to have therapeutic value. For example, the dsRNA molecules can be administered to a subject or can be administered to other appropriate cells evident to those skilled in the art, individually or in combination with one or more drugs under conditions suitable for the treatment.

The dsRNA molecules also can be used in combination with other known treatments to treat, inhibit, reduce, or prevent a disease or disorder for which inhibition of AT3 is predicted to or has been demonstrated to have therapeutic value in a subject or organism. For example, the described molecules could be used in combination with one or more known compounds, treatments, or procedures to treat, inhibit, reduce, or prevent a disease or disorder for which inhibition of AT3 is predicted to or has been demonstrated to have therapeutic value in a subject or organism as are known in the art.

A dsRNA agent of the invention can be conjugated (e.g., at its 5' or 3' terminus of its sense or antisense strand) or unconjugated to another moiety (e.g. a non-nucleic acid moiety such as a peptide), or to an organic compound (e.g., a dye, cholesterol, or the like). Modifying dsRNA agents in this way may improve cellular uptake or enhance cellular targeting activities of the resulting dsRNA agent derivative as compared to the corresponding unconjugated dsRNA agent, are useful for tracing the dsRNA agent derivative in the cell, or improve the stability of the dsRNA agent derivative compared to the corresponding unconjugated dsRNA agent.

In certain embodiments, specific exemplary forms of dsRNA conjugates are contemplated. Notably, RNAi therapies, such as the dsRNAs that are specifically exemplified herein, have demonstrated particularly good ability to be delivered to the cells of the liver in vivo (via, e.g., lipid nanoparticles and/or conjugates such as dynamic polyconjugates or GalNAc conjugates—in certain exemplary embodiments, one or more GalNAc moieties can be conjugated to a 3'- and/or 5'-overhang region of a dsNA, optionally to an "extended" overhang region of a dsNA (e.g., to a 5 or more nucleotide, 8 or more nucleotide, etc. example of such an overhang); additionally and/or alternatively, one or more GalNAc moieties can be conjugated to ds extended regions of a dsNA, e.g., to the duplex region formed by the 5'-end region of the guide/antisense strand of a dsNA and the corresponding 3'-end region of the passenger/sense strand of a dsNA and/or to the duplex region formed by the 3'-end region of the guide/antisense strand of a dsNA and the corresponding 5'-end region of the passenger/sense strand of a dsNA). Thus, formulated RNAi therapies, such as those described herein, are attractive modalities for treating or preventing diseases or disorders that are present in, originate in or otherwise involve the liver.

Methods of Introducing Nucleic Acids, Vectors, and Host Cells dsRNA agents of the invention may be directly introduced into a cell (i.e., intracellularly); or introduced extracellularly into a cavity, interstitial space, into the circulation of an organism, introduced orally, or may be introduced by bathing a cell or organism in a solution containing the nucleic acid. Vascular or extravascular circulation, the blood or lymph system, and the cerebrospinal fluid are sites where the nucleic acid may be introduced.

The dsRNA agents of the invention can be introduced using nucleic acid delivery methods known in art including injection of a solution containing the nucleic acid, bombardment by particles covered by the nucleic acid, soaking the cell or organism in a solution of the nucleic acid, or electroporation of cell membranes in the presence of the nucleic acid. Other methods known in the art for introducing nucleic acids to cells may be used, such as lipid-mediated carrier transport, chemical-mediated transport, and cationic liposome transfection such as calcium phosphate, and the like. The nucleic acid may be introduced along with other components that perform one or more of the following activities: enhance nucleic acid uptake by the cell or otherwise increase inhibition of the target AT3 RNA.

A cell having a target AT3 RNA may be from the germ line or somatic, totipotent or pluripotent, dividing or non-dividing, parenchyma or epithelium, immortalized or transformed, or the like. The cell may be a stem cell or a differentiated cell. Cell types that are differentiated include adipocytes, fibroblasts, myocytes, cardiomyocytes, endothelium, neurons, glia, blood cells, megakaryocytes, lymphocytes, macrophages, neutrophils, eosinophils, basophils, mast cells, leukocytes, granulocytes, keratinocytes, chondrocytes, osteoblasts, osteoclasts, hepatocytes, and cells of the endocrine or exocrine glands.

Depending on the particular target AT3 RNA sequence and the dose of dsRNA agent material delivered, this process may provide partial or complete loss of function for the AT3 RNA. A reduction or loss of RNA levels or expression (either AT3 RNA expression or encoded polypeptide expression) in at least 50%, 60%, 70%, 80%, 90%, 95% or 99% or more of targeted cells is exemplary. Inhibition of AT3 RNA levels or expression refers to the absence (or observable decrease) in the level of AT3 RNA or AT3 RNA-encoded protein. Specificity refers to the ability to inhibit the AT3 RNA without manifest effects on other genes of the cell. The consequences of inhibition can be confirmed by examination of the outward properties of the cell or organism or by biochemical techniques such as RNA solution hybridization, nuclease protection, Northern hybridization, reverse transcription, gene expression monitoring with a microarray, antibody binding, enzyme linked immunosorbent assay (ELISA), Western blotting, radioimmunoassay (RIA), other immunoassays, and fluorescence activated cell analysis (FACS). Inhibition of target AT3 RNA sequence(s) by the dsRNA agents of the invention also can be measured based upon the effect of administration of such dsRNA agents upon development/progression of a disease or disorder for which inhibition of AT3 is predicted to or has been demonstrated to have therapeutic value, e.g., hemophilia or other rare disease, either in vivo or in vitro. Treatment and/or reductions in hemophilia and/or other rare disease can include halting or reduction of organ damage (e.g., blood, bone marrow and/or thrombosis-associated damage) associated with hemophilia or other rare disease (e.g., reduction of blood damage, bone marrow damage or thrombosis e.g., 10%, 20%, 30%, 40%, 50%, 60%, 70%, 80%, 90%, 95% or 99% or more, and can also be measured in logarithmic terms, e.g., 10-fold, 100-fold, 1000-fold, $10^5$-fold, $10^6$-fold, $10^7$-fold reduction in blood damage, bone marrow damage or thrombolytic damage could be achieved via administration of the dsRNA agents of the invention to cells, a tissue, or a subject).

For RNA-mediated inhibition in a cell line or whole organism, expression of a reporter or drug resistance gene whose protein product is easily assayed can be measured. Such reporter genes include acetohydroxyacid synthase (AHAS), alkaline phosphatase (AP), beta galactosidase (LacZ), beta glucoronidase (GUS), chloramphenicol acetyltransferase (CAT), green fluorescent protein (GFP), horseradish peroxidase (HRP), luciferase (Luc), nopaline synthase (NOS), octopine synthase (OCS), and derivatives thereof. Multiple selectable markers are available that confer resistance to ampicillin, bleomycin, chloramphenicol, gentarnycin, hygromycin, kanamycin, lincomycin, methotrexate, phosphinothricin, puromycin, and tetracyclin. Depending on the assay, quantitation of the amount of gene expression allows one to determine a degree of inhibition which is greater than 10%, 33%, 50%, 90%, 95% or 99% as compared to a cell not treated according to the present invention.

Lower doses of injected material and longer times after administration of RNA silencing agent may result in inhibition in a smaller fraction of cells (e.g., at least 10%, 20%, 50%, 75%, 90%, or 95% of targeted cells). Quantitation of gene expression in a cell may show similar amounts of inhibition at the level of accumulation of target AT3 RNA or translation of target protein. As an example, the efficiency of inhibition may be determined by assessing the amount of gene product in the cell; RNA may be detected with a hybridization probe having a nucleotide sequence outside the region used for the inhibitory dsRNA, or translated polypeptide may be detected with an antibody raised against the polypeptide sequence of that region.

The dsRNA agent may be introduced in an amount which allows delivery of at least one copy per cell. Higher doses (e.g., at least 5, 10, 100, 500 or 1000 copies per cell) of material may yield more effective inhibition; lower doses may also be useful for specific applications.

AT3 Biology

Antithrombin III (AT3) is an inhibitor of the coagulation cascade. Nearly 80% of its inhibitory activity is against the clotting protein, thrombin. AT3 has been previously identified as a high-value drug target, in part because it has a higher plasma concentration than a current target protein for hemophilia, TFPI (Tissue Factor Pathway Inhibitor). Also, the AT3 half-life is significantly longer than that of TFPI (indeed, it was suggested that inhibition of TFPI in recent trials failed to produce a therapeutic impact in humans due to TFPI's short half-life). Finally, patients undergoing anti-TFPI antibody therapy for treatment often acquire resistance, indicating that a novel and/or complementary approach to treatment is necessary.

Patients with hemophilia often show deficiency in clotting factors (proteins), which are necessary for clot formation and to maintain the integrity of a clot. Three types of hemophilia have been identified and are classified according to the deficient factor. Hemophilia A is the most common and is caused by insufficient levels of factor VIII, whereas hemophilia B and C are less common and are caused by insufficient factor IX and XI levels, respectively.

Antithrombin III (AT3) is a natural anticoagulant and a genetically defined target. AT3 is expressed in the liver and circulates in the plasma. It inactivates thrombin, a protein critically involved in clotting. When activated, thrombin activates clotting factors (such as conversion of Factor XIII to XIIIa), which in turn act on fibrin to form an insoluble clot. While primarily an inhibitor of thrombin, AT3 also inhibits certain activated clotting factors (Xa, IXa, XaI, XIIa, IIa, and VIIa). Thus, an effective inhibitor of AT3 would block the ability of AT3 to inactivate thrombin, resulting in increased active thrombin and clot formation, thereby providing an additional hemophilia therapeutic.

Recently, Tissue Factor Pathway Inhibitor (TFPI) has also been targeted for inhibition, as a protein that negatively regulates the coagulation cascade. Concizumab, a monoclonal anti-TFPI antibody, binds to the active site of TFPI, blocking its interaction with activated clotting factor X. By inhibiting this interaction, the clot-forming functions of the factors are largely preserved, and a clot is formed.

A nucleic acid aptamer, BAX 499, has also been identified to tightly and specifically bind to TFPI and inhibit its function, mediating a procoagulant effect in hemophilic plasma models. Although the compound performed well in animal studies, human trials were unsuccessful and were terminated due to an increased number of bleeding events. It was suggested that the compound did not completely deactivate TFPI, resulting instead in increasing concentrations of TFPI and an anti-clotting effect.

Patients with hemophilia experience spontaneous, uncontrolled internal bleeding that is painful, debilitating, damaging to joints and potentially fatal. Hemophilic children often suffer large and frequent bruising, nosebleeds and prolonged bleeding after surgery (specifically oral surgery).

Nearly 70% of hemophilic cases are genetically inherited, and in the remaining 30%, there is no family history and the condition is the result of a spontaneous gene mutation. According to the WHO, more than 400,000 people in the world have hemophilia, and all races and economic groups are equally affected.

Hemophilia Diagnosis

Hemophilia A and B are inherited in an X-linked recessive pattern. The genes associated with these conditions are located on the X chromosome. In males, one altered copy of the gene is sufficient to cause the condition, whereas in females, a mutation in both copies of the gene is required to cause the disease.

In children and adults, a blood test can show a clotting factor deficiency or absence. A blood test is required to diagnose a bleeding disorder, and it shows the type of hemophilia and severity. An activated partial thromboplastin time (APTT) test can measure how long it takes for blood to clot. The test measures the clotting ability of factors VIII, IX and XII. Likewise, a prothrombin time (PT) test measures the clotting ability of factors I, II V, VII and X. In both tests, if the factors are too low, it takes longer for the blood to clot. Patients with severe to moderate hemophilia have less than 1% to 5% of normal levels of factor VIII or IX in their blood. A patient with mild hemophilia may not exhibit symptoms until after an injury or surgical event. In the vast majority of cases, hemophilia is diagnosed at 9 months, and almost always by age 2. Clotting factor tests can also be performed on a newborn infant, from an umbilical cord blood sample.

Hemophilia Complications

Depending on the severity of the case, patients with hemophilia may suffer severe and frequent bleeds (either internal or external bleeding episodes). The most common type of internal bleed is a joint bleed, where blood enters the joint spaces. This event can transpire spontaneously, without any evident trauma. If joint bleeds are not property treated, scarring and joint deformity can occur. In children, first symptoms include frequent and large bruises from bumps and falls as they learn to walk. Additionally, heavy bleeding from a dental procedure, accident or surgery is also an early sign of hemophilia. Blood in the urine may occasionally occur, due to bleeding within the kidneys.

Severe complications in moderate to severe hemophiliacs are common, and can be a result of treatment, or directly from the disease. Some of the complications include deep internal bleeding, joint damage, transfusion transmitted infection, adverse reactions to clotting factor treatment (i.e. development of immune inhibitor and rendering the treatment less effective), and intracranial hemorrhage.

Hemophilia Classification

Hemophilia is classified by the context under which it is diagnosed. Three types of hemophilia are classified according to the deficient factor. Hemophilia A is the most common and is caused by insufficient levels of factor VIII, whereas hemophilia B and C are less common and are caused by insufficient factor IX and XI levels, respectively.

Hemophilia Pathophysiology

Many proteins are involved in the coagulation cascade. Hemophilia occurs as a result of having one (or more) of these proteins deficient or absent. Thrombin, an integral protein of the coagulation cascade, is a serine protease that converts soluble fibrinogen into insoluble strands of fibrin, which is responsible for clot formation. Thrombin also activates clotting factors which are in turn involved in insoluble clot formation.

AT3 is a natural anticoagulant that inactivates thrombin via inhibition of thrombin's serine protease activity. Inhibition of AT3 results in increased levels of activated thrombin, clotting factors, and ultimately insoluble clot formation.

Hemophilia Management

Infusions of Deficient Clotting Factor

Currently, clotting factor replacement can be used to manage hemophilic symptoms. The clotting factors may be recombinant proteins, isolated from human blood serum, or a combination of the two. Some patients develop antibodies against the replacement factors, therefore requiring increased concentrations of the replacement products. Prophylaxis treatment involves infusion of clotting factor on a regular schedule in order to prevent spontaneous bleeding events. Alternatively, on-demand treatments treat the bleeding when they occur.

Medications

Medications to prevent clots from breaking down may be administered to patients (antifibrinolytics). Similarly, medications (fibrin sealants) can be applied directly to the wound site to promote clotting and healing. Alternatively, hemophilia patients should avoid medications that prevent blood clotting (i.e. heparin, warfarin and prasugrel).

Preventative Exercises and Physical Therapy

Patients with hemophilia are recommended to do specific exercises to strengthen their joints (specifically the elbows, knees and ankles) in order to protect them from damaging bleeds. The exercises include flexibility training, toning, and increasing strength of muscles. Furthermore, contact sports, where the risk for injury is high, are not safe for patients with hemophilia.

Hemophilia Epidemiology

Hemophilia is rare, and occurs with only 1 instance in every 10,000 births (1 in 5,000 live male births) for Hemophilia A, and 1 in 50,000 births for hemophilia B. The number of people with hemophilia in the United States is estimated to be about 20,000 individuals, and about 400 babies are born each year with the disorder. The worldwide incidence of hemophilia is not well known, but an estimated 400,000 people suffer from the disease. Approximately 75% of people with hemophilia receive inadequate treatment or have no access to treatment at all.

Pharmaceutical Compositions

In certain embodiments, the present invention provides for a pharmaceutical composition comprising the dsRNA agent of the present invention. The dsRNA agent sample can be suitably formulated and introduced into the environment of the cell by any means that allows for a sufficient portion of the sample to enter the cell to induce gene silencing, if it is to occur. Many formulations for dsRNA are known in the art and can be used so long as the dsRNA gains entry to the target cells so that it can act. See, e.g., U.S. published patent application Nos. 2004/0203145 A1 and 2005/0054598 A1. For example, the dsRNA agent of the instant invention can be formulated in buffer solutions such as phosphate buffered saline solutions, liposomes, micellar structures, and capsids. Formulations of dsRNA agent with cationic lipids can be used to facilitate transfection of the dsRNA agent into cells. For example, cationic lipids, such as lipofectin (U.S. Pat. No. 5,705,188), cationic glycerol derivatives, and polycationic molecules, such as polylysine (published PCT International Application WO 97/30731), can be used. Suitable lipids include Oligofectamine, Lipofectamine (Life Technologies), NC388 (Ribozyme Pharmaceuticals, Inc., Boulder, Colo.), or FuGene 6 (Roche) all of which can be used according to the manufacturer's instructions.

Such compositions typically include the nucleic acid molecule and a pharmaceutically acceptable carrier. As used herein the language "pharmaceutically acceptable carrier" includes saline, solvents, dispersion media, coatings, antibacterial and antifungal agents, isotonic and absorption delaying agents, and the like, compatible with pharmaceutical administration. Supplementary active compounds can also be incorporated into the compositions.

A pharmaceutical composition is formulated to be compatible with its intended route of administration. Examples of routes of administration include parenteral, e.g., intravenous, intradermal, subcutaneous, oral (e.g., inhalation), transdermal (topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; cHuh7ting agents such as ethylenediaminetetraacetic acid; buffers such as acetates, citrates or phosphates and agents for the adjustment of tonicity such as sodium chloride or dextrose. pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). In all cases, the composition must be sterile and should be fluid to the extent that easy syringability exists. It should be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyetheylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as manitol, sorbitol, sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound in the required amount in a selected solvent with one or a combination of ingredients enumerated above, as required, followed by filtered sterilization. Generally, dispersions are prepared by incorporating the active compound into a sterile vehicle, which contains a basic dispersion medium and the required other ingredients from those enumerated above. In the case of sterile powders for the preparation of sterile injectable solutions, the preferred methods of preparation are vacuum drying and freeze-drying which yields a powder of the active ingredient plus any additional desired ingredient from a previously sterile-filtered solution thereof.

Oral compositions generally include an inert diluent or an edible carrier. For the purpose of oral therapeutic administration, the active compound can be incorporated with excipients and used in the form of tablets, troches, or capsules, e.g., gelatin capsules. Oral compositions can also be prepared using a fluid carrier for use as a mouthwash. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from pressured container or dispenser which contains a suitable propellant, e.g., a gas such as carbon dioxide, or a nebulizer. Such methods include those described in U.S. Pat. No. 6,468,798.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

The compounds can also be administered by transfection or infection using methods known in the art, including but not limited to the methods described in McCaffrey et al. (2002), Nature, 418(6893), 38-9 (hydrodynamic transfection); Xia et al. (2002), Nature Biotechnol., 20(10), 1006-10 (viral-mediated delivery); or Putnam (1996), Am. J. Health Syst. Pharm. 53(2), 151-160, erratum at Am. J. Health Syst. Pharm. 53(3), 325 (1996).

The compounds can also be administered by a method suitable for administration of nucleic acid agents, such as a DNA vaccine. These methods include gene guns, bio injectors, and skin patches as well as needle-free methods such as the micro-particle DNA vaccine technology disclosed in U.S. Pat. No. 6,194,389, and the mammalian transdermal needle-free vaccination with powder-form vaccine as disclosed in U.S. Pat. No. 6,168,587. Additionally, intranasal delivery is possible, as described in, inter alia, Hamajima et al. (1998), Clin. Immunol. Immunopathol., 88(2), 205-10. Liposomes (e.g., as described in U.S. Pat. No. 6,472,375) and microencapsulation can also be used. Biodegradable targetable microparticle delivery systems can also be used (e.g., as described in U.S. Pat. No. 6,471,996).

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Such formulations can be prepared using standard techniques. The materials can also be obtained commercially from Alza Corporation and Nova Pharmaceuticals, Inc. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$. Compounds which exhibit high therapeutic indices are preferred. While compounds that exhibit toxic side effects may be used, care should be taken to design a delivery system that targets such compounds to the site of affected tissue in order to minimize potential damage to uninfected cells and, thereby, reduce side effects.

The data obtained from the cell culture assays and animal studies can be used in formulating a range of dosage for use in humans. The dosage of such compounds lies preferably within a range of circulating concentrations that include the $ED_{50}$ with little or no toxicity. The dosage may vary within this range depending upon the dosage form employed and the route of administration utilized. For a compound used in the method of the invention, the therapeutically effective dose can be estimated initially from cell culture assays. A dose may be formulated in animal models to achieve a circulating plasma concentration range that includes the $IC_{50}$ (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

As defined herein, a therapeutically effective amount of a nucleic acid molecule (i.e., an effective dosage) depends on the nucleic acid selected. For instance, single dose amounts of a dsRNA (or, e.g., a construct(s) encoding for such dsRNA) in the range of approximately 1 pg to 1000 mg may be administered; in some embodiments, 10, 30, 100, or 1000 pg, or 10, 30, 100, or 1000 ng, or 10, 30, 100, or 1000 µg, or 10, 30, 100, or 1000 mg may be administered. In some embodiments, 1-5 g of the compositions can be administered. The compositions can be administered one from one or more times per day to one or more times per week; including once every other day. The skilled artisan will appreciate that certain factors may influence the dosage and timing required to effectively treat a subject, including but not limited to the severity of the disease or disorder, previous treatments, the general health and/or age of the subject, and other diseases present. Moreover, treatment of a subject with a therapeutically effective amount of a nucleic acid (e.g., dsRNA), protein, polypeptide, or antibody can include a single treatment or, preferably, can include a series of treatments.

The nucleic acid molecules of the invention can be inserted into expression constructs, e.g., viral vectors, retroviral vectors, expression cassettes, or plasmid viral vectors, e.g., using methods known in the art, including but not limited to those described in Xia et al., (2002), supra. Expression constructs can be delivered to a subject by, for example, inhalation, orally, intravenous injection, local administration (see U.S. Pat. No. 5,328,470) or by stereotactic injection (see e.g., Chen et al. (1994), *Proc. Natl. Acad. Sci. USA,* 91, 3054-3057). The pharmaceutical preparation of the delivery vector can include the vector in an acceptable diluent, or can comprise a slow release matrix in which the delivery vehicle is imbedded. Alternatively, where the complete delivery vector can be produced intact from recombinant cells, e.g., retroviral vectors, the pharmaceutical preparation can include one or more cells which produce the gene delivery system.

The expression constructs may be constructs suitable for use in the appropriate expression system and include, but are not limited to retroviral vectors, linear expression cassettes, plasmids and viral or virally-derived vectors, as known in the art. Such expression constructs may include one or more inducible promoters, RNA Pol III promoter systems such as U6 snRNA promoters or H1 RNA polymerase III promoters, or other promoters known in the art. The constructs can include one or both strands of the siRNA. Expression constructs expressing both strands can also include loop structures linking both strands, or each strand can be separately transcribed from separate promoters within the same construct. Each strand can also be transcribed from a separate expression construct, e.g., Tuschl (2002, *Nature Biotechnol* 20: 500-505).

It can be appreciated that the method of introducing dsRNA agents into the environment of the cell will depend on the type of cell and the make up of its environment. For example, when the cells are found within a liquid, one preferable formulation is with a lipid formulation such as in lipofectamine and the dsRNA agents can be added directly to the liquid environment of the cells. Lipid formulations can also be administered to animals such as by intravenous, intramuscular, or intraperitoneal injection, or orally or by inhalation or other methods as are known in the art. When the formulation is suitable for administration into animals such as mammals and more specifically humans, the formulation is also pharmaceutically acceptable. Pharmaceutically acceptable formulations for administering oligonucleotides are known and can be used. In some instances, it may be preferable to formulate dsRNA agents in a buffer or saline solution and directly inject the formulated dsRNA agents into cells, as in studies with oocytes. The direct injection of dsRNA agent duplexes may also be done. For suitable methods of introducing dsRNA (e.g., DsiRNA agents), see U.S. published patent application No. 2004/0203145 A1.

Suitable amounts of a dsRNA agent must be introduced and these amounts can be empirically determined using standard methods. Typically, effective concentrations of individual dsRNA agent species in the environment of a cell will be 50 nanomolar or less, 10 nanomolar or less, or compositions in which concentrations of 1 nanomolar or less can be used. In another embodiment, methods utilizing a concentration of 200 picomolar or less, 100 picomolar or less, 50 picomolar or less, 20 picomolar or less, and even a concentration of 10 picomolar or less, 5 picomolar or less, 2 picomolar or less or 1 picomolar or less can be used in many circumstances.

The method can be carried out by addition of the dsRNA agent compositions to an extracellular matrix in which cells can live provided that the dsRNA agent composition is formulated so that a sufficient amount of the dsRNA agent can enter the cell to exert its effect. For example, the method is amenable for use with cells present in a liquid such as a liquid culture or cell growth media, in tissue explants, or in whole organisms, including animals, such as mammals and especially humans.

The level or activity of an AT3 RNA can be determined by a suitable method now known in the art or that is later developed. It can be appreciated that the method used to measure a target RNA and/or the expression of a target RNA can depend upon the nature of the target RNA. For example, where the target AT3 RNA sequence encodes a protein, the term "expression" can refer to a protein or the AT3 RNA/transcript derived from the AT3 gene (either genomic or of exogenous origin). In such instances the expression of the target AT3 RNA can be determined by measuring the amount of AT3 RNA/transcript directly or by measuring the amount of AT3 protein. Protein can be measured in protein assays such as by staining or immunoblotting or, if the protein catalyzes a reaction that can be measured, by measuring reaction rates. All such methods are known in the art and can be used. Where target AT3 RNA levels are to be measured, art-recognized methods for detecting RNA levels can be used (e.g., RT-PCR, Northern Blotting, etc.). In targeting AT3 RNAs with the dsRNA agents of the instant invention, it is also anticipated that measurement of the efficacy of a dsRNA agent in reducing levels of AT3 RNA or protein in a subject, tissue, in cells, either in vitro or in vivo, or in cell extracts can also be used to determine the extent of reduction of AT3-associated phenotypes (e.g., disease or disorders, e.g., hemophilia-associated biomarkers and/or phenotypes, other rare diseases and associated biomarkers and/or phenotypes, etc.). The above measurements can be made on cells, cell extracts, tissues, tissue extracts or other suitable source material.

The determination of whether the expression of an AT3 RNA has been reduced can be by a suitable method that can reliably detect changes in RNA levels. Typically, the determination is made by introducing into the environment of a cell undigested dsRNA such that at least a portion of that dsRNA agent enters the cytoplasm, and then measuring the level of the target RNA. The same measurement is made on identical untreated cells and the results obtained from each measurement are compared.

The dsRNA agent can be formulated as a pharmaceutical composition which comprises a pharmacologically effective amount of a dsRNA agent and pharmaceutically acceptable carrier. A pharmacologically or therapeutically effective amount refers to that amount of a dsRNA agent effective to produce the intended pharmacological, therapeutic or preventive result. The phrases "pharmacologically effective amount" and "therapeutically effective amount" or simply "effective amount" refer to that amount of an RNA effective to produce the intended pharmacological, therapeutic or preventive result. For example, if a given clinical treatment is considered effective when there is at least a 20% reduction in a measurable parameter associated with a disease or disorder, a therapeutically effective amount of a drug for the treatment of that disease or disorder is the amount necessary to effect at least a 20% reduction in that parameter.

Suitably formulated pharmaceutical compositions of this invention can be administered by means known in the art such as by parenteral routes, including intravenous, intramuscular, intraperitoneal, subcutaneous, transdermal, airway (aerosol), rectal, vaginal and topical (including buccal and sublingual) administration. In some embodiments, the pharmaceutical compositions are administered by intravenous or intraparenteral infusion or injection.

In general, a suitable dosage unit of dsRNA will be in the range of 0.001 to 0.25 milligrams per kilogram body weight of the recipient per day, or in the range of 0.01 to 20 micrograms per kilogram body weight per day, or in the range of 0.001 to 5 micrograms per kilogram of body weight per day, or in the range of 1 to 500 nanograms per kilogram of body weight per day, or in the range of 0.01 to 10 micrograms per kilogram body weight per day, or in the range of 0.10 to 5 micrograms per kilogram body weight per day, or in the range of 0.1 to 2.5 micrograms per kilogram body weight per day. A pharmaceutical composition comprising the dsRNA can be administered once daily. However, therapeutic agent may also be dosed in dosage units containing two, three, four, five, six or more sub-doses administered at appropriate intervals throughout the day. In that case, the dsRNA contained in each sub-dose must be correspondingly smaller in order to achieve the total daily dosage unit. The dosage unit can also be compounded for a single dose over several days, e.g., using a conventional sustained release formulation which provides sustained and consistent release of the dsRNA over a several day period. Sustained release formulations are well known in the art. In this embodiment, the dosage unit contains a corresponding multiple of the daily dose. Regardless of the formulation, the pharmaceutical composition must contain dsRNA in a quantity sufficient to inhibit expression of the target gene in the animal or human being treated. The composition can be compounded in such a way that the sum of the multiple units of dsRNA together contain a sufficient dose.

Data can be obtained from cell culture assays and animal studies to formulate a suitable dosage range for humans. The dosage of compositions of the invention lies within a range of circulating concentrations that include the $ED_{50}$ (as determined by known methods) with little or no toxicity. The dosage may vary within this range depending upon the dosage form employed and the route of administration utilized. For a compound used in the method of the invention, therapeutically effective dose can be estimated initially from cell culture assays. A dose may be formulated in animal models to achieve a circulating plasma concentration range of the compound that includes the $IC_{50}$ (i.e., the concentration of the test compound which achieves a half-maximal inhibition of symptoms) as determined in cell culture. Such information can be used to more accurately determine useful doses in humans. Levels of dsRNA in plasma may be measured by standard methods, for example, by high performance liquid chromatography.

The pharmaceutical compositions can be included in a kit, container, pack, or dispenser together with instructions for administration.

Methods of Treatment

The present invention provides for both prophylactic and therapeutic methods of treating a subject at risk of (or susceptible to) a disease or disorder caused, in whole or in part, by AT3 (e.g., normal functioning or misregulation and/or elevation of AT3 transcript and/or AT3 protein levels), or treatable via selective targeting of AT3.

"Treatment", or "treating" as used herein, is defined as the application or administration of a therapeutic agent (e.g., a dsRNA agent or vector or transgene encoding same) to a patient, or application or administration of a therapeutic agent to an isolated tissue or cell line from a patient, who has the disease or disorder, a symptom of disease or disorder or a predisposition toward a disease or disorder, with the purpose to cure, heal, alleviate, relieve, alter, remedy, ameliorate, improve or affect the disease or disorder, the symptoms of the disease or disorder, or the predisposition toward disease.

In one aspect, the invention provides a method for preventing in a subject, a disease or disorder as described above (including, e.g., prevention of the commencement of, e.g., hemophilia-forming events within a subject via inhibition of AT3 expression), by administering to the subject a therapeutic agent (e.g., a dsRNA agent or vector or transgene encoding same). Subjects at risk for the disease can be identified by, for example, one or a combination of diagnostic or prognostic assays as described herein. Administration of a prophylactic agent can occur prior to the detection of, e.g., hemophilia in a subject, or the manifestation of symptoms characteristic of the disease or disorder, such that the disease or disorder is prevented or, alternatively, delayed in its progression.

Another aspect of the invention pertains to methods of treating subjects therapeutically, i.e., altering the onset of symptoms of the disease or disorder. These methods can be performed in vitro (e.g., by culturing the cell with the dsRNA agent) or, alternatively, in vivo (e.g., by administering the dsRNA agent to a subject).

With regards to both prophylactic and therapeutic methods of treatment, such treatments may be specifically tailored or modified, based on knowledge obtained from the field of pharmacogenomics. "Pharmacogenomics", as used herein, refers to the application of genomics technologies such as gene sequencing, statistical genetics, and gene expression analysis to drugs in clinical development and on the market. More specifically, the term refers the study of how a patient's genes determine his or her response to a drug (e.g., a patient's "drug response phenotype", or "drug response genotype"). Thus, another aspect of the invention provides methods for tailoring an individual's prophylactic or therapeutic treatment with either the target AT3 RNA molecules of the present invention or target AT3 RNA modulators according to that individual's drug response genotype. Pharmacogenomics allows a clinician or physician to target prophylactic or therapeutic treatments to patients who will most benefit from the treatment and to avoid treatment of patients who will experience toxic drug-related side effects.

Therapeutic agents can be tested in a selected animal model. For example, a dsRNA agent (or expression vector or transgene encoding same) as described herein can be used in an animal model to determine the efficacy, toxicity, or side effects of treatment with said agent. Alternatively, an agent (e.g., a therapeutic agent) can be used in an animal model to determine the mechanism of action of such an agent.

Models Useful to Evaluate the Down-Regulation of AT3 mRNA Levels and Expression

Cell Culture

The dsRNA agents of the invention can be tested for cleavage activity in vivo, for example, using the following procedure. The nucleotide sequences within the AT3 cDNA targeted by the dsRNA agents of the invention are shown in the above AT3 sequences.

The dsRNA reagents of the invention can be tested in cell culture using HepG2 or other mammalian cells (e.g., human cell lines Hep3B, HeLa, DU145, Calu3, SW480, T84, PL45, etc., and mouse cell lines H36.12J, Hepa1-6, AML12, Neuro2a, etc.) to determine the extent of AT3 RNA and/or AT3 protein inhibition. In certain embodiments, DsiRNA reagents (e.g., see FIG. 1, and above-recited structures) are selected against the AT3 target as described herein. AT3 RNA inhibition is measured after delivery of these reagents by a suitable transfection agent to, for example, cultured HepG2 cells or other transformed or non-transformed mammalian cells in culture. Relative amounts of target AT3 RNA are measured by reporter assay (e.g., as exemplified below) and/or versus HPRT1, actin or other appropriate control using real-time PCR monitoring of amplification (e.g., ABI 7700 TAQMAN®). A comparison is made to the activity of oligonucleotide sequences made to unrelated targets or to a randomized DsiRNA control with the same overall length and chemistry, or simply to appropriate vehicle-treated or untreated controls. Primary and secondary lead reagents are chosen for the target and optimization performed.

TAQMAN® (Real-Time PCR Monitoring of Amplification) and Lightcycler Quantification of mRNA For RT-qPCR assays, total RNA is prepared from cells following DsiRNA delivery, for example, using Ambion Rnaqueous 4-PCR purification kit for large scale extractions, or Promega SV96 for 96-well assays. For Taqman analysis, dual-labeled probes are synthesized with, for example, the reporter dyes FAM or VIC covalently linked at the 5'-end and the quencher dye TAMRA conjugated to the 3'-end. PCR amplifications are performed on, for example, an ABI PRISM 7700 Sequence detector using 50 uL reactions consisting of 10 uL total RNA, 100 nM forward primer, 100 mM reverse primer, 100 nM probe, 1×TaqMan PCR reaction buffer (PE-Applied Biosystems), 5.5 mM MgCl2, 100 uM each dATP, dCTP, dGTP and dTTP, 0.2 U RNase Inhibitor (Promega), 0.025 U AmpliTaq Gold (PE-Applied Biosystems) and 0.2 U M-MLV Reverse Transcriptase (Promega). The thermal cycling conditions can consist of 30 minutes at 48° C., 10 minutes at 95° C., followed by 40 cycles of 15 seconds at 95° C. and 1 minute at 60° C. Quantitation of target AT3 mRNA level is determined relative to standards generated from serially diluted total cellular RNA (300, 100, 30, 10 ng/rxn) and normalizing to, for example, HPRT1 mRNA in either parallel or same tube TaqMan reactions.

Western Blotting

Cellular protein extracts can be prepared using a standard micro preparation technique (for example using RIPA buffer). Cellular protein extracts are run on Tris-Glycine polyacrylamide gel and transferred onto membranes. Non-specific binding can be blocked by incubation, for example, with 5% non-fat milk for 1 hour followed by primary antibody for 16 hours at 4° C. Following washes, the secondary antibody is applied, for example (1:10,000 dilution) for 1 hour at room temperature and the signal detected on a VersaDoc imaging system In several cell culture systems, cationic lipids have been shown to enhance the bioavailability of oligonucleotides to cells in culture (Bennet, et al., 1992, Mol. Pharmacology, 41, 1023-1033). In one embodiment, dsRNA molecules of the invention are complexed with cationic lipids for cell culture experiments. dsRNA and cationic lipid mixtures are prepared in serum-free OptimMEM (InVitrogen) immediately prior to addition to the cells. OptiMEM is warmed to room temperature (about 20-25° C.) and cationic lipid is added to the final desired concentration. dsRNA molecules are added to OptiMEM to the desired concentration and the solution is added to the diluted dsRNA and incubated for 15 minutes at room temperature. In dose response experiments, the RNA complex is serially diluted into OptiMEM prior to addition of the cationic lipid.

Animal Models

The efficacy of anti-AT3 dsRNA agents may be evaluated in an animal model. Animal models of PNH as are known in the art can be used for evaluation of the efficacy, potency, toxicity, etc. of anti-AT3 dsRNAs. Exemplary animal models useful for assessment of anti-AT3 dsRNAs include genetically engineered mouse models of PNH disease. Such animal models may also be used as source cells or tissue for assays of the compositions of the invention. Such models can additionally be used or adapted for use for pre-clinical evaluation of the efficacy of dsRNA compositions of the invention in modulating AT3 gene expression toward therapeutic use.

Such models and/or wild-type mice can be used in evaluating the efficacy of dsRNA molecules of the invention to inhibit AT3 levels, expression, development of AT3-associated phenotypes, diseases or disorders, etc. These models, wild-type mice and/or other models can similarly be used to evaluate the safety/toxicity and efficacy of dsRNA molecules of the invention in a pre-clinical setting.

Specific examples of animal model systems useful for evaluation of the AT3-targeting dsRNAs of the invention include wild-type mice and genetically engineered mice, e.g., CHF$^{-/-}$ mice and PIG-a$^{flox}$ mice, as described in Goicoechea de Jorge et al. (*J Am Soc Nephrol* 22: 137-145), Tarutani et al. (*Proc. Natl. Acad. Sci. USA* 94: 7400-7405), and Visconte et al. (*Haematologica* 95: 214-223). In an exemplary in vivo experiment, dsRNAs of the invention are tail vein injected into such mouse models at doses ranging from 0.1 to 1 to 10 mg/kg or, alternatively, repeated doses are administered at single-dose IC$_{50}$ levels, and organ samples (e.g., blood or bone marrow, but may also include prostate, kidney, lung, pancreas, colon, skin, spleen, liver, lymph nodes, mammary fat pad, etc.) are harvested 24 hours after administration of the final dose. Such organs are then evaluated for mouse and/or human AT3 levels, depending upon the model used, and/or for impact upon hemophilia-related phenotypes. Duration of action can also be examined at, e.g., 1, 4, 7, 14, 21 or more days after final dsRNA administration.

The practice of the present invention employs, unless otherwise indicated, conventional techniques of chemistry, molecular biology, microbiology, recombinant DNA, genetics, immunology, cell biology, cell culture and transgenic biology, which are within the skill of the art. See, e.g., Maniatis et al., 1982, Molecular Cloning (Cold Spring Harbor Laboratory Press, Cold Spring Harbor, N.Y.); Sambrook et al., 1989, Molecular Cloning, 2nd Ed. (Cold Spring Harbor Laboratory Press, Cold Spring Harbor, N.Y.); Sambrook and Russell, 2001, Molecular Cloning, 3rd Ed. (Cold Spring Harbor Laboratory Press, Cold Spring Harbor, N.Y.); Ausubel et al., 1992), Current Protocols in Molecular Biology (John Wiley & Sons, including periodic updates); Glover, 1985, DNA Cloning (IRL Press, Oxford); Anand, 1992; Guthrie and Fink, 1991; Harlow and Lane, 1988, Antibodies, (Cold Spring Harbor Laboratory Press, Cold Spring Harbor, N.Y.); Jakoby and Pastan, 1979; Nucleic Acid Hybridization (B. D. Hames & S. J. Higgins eds. 1984); Transcription And Translation (B. D. Hames & S. J. Higgins eds. 1984); Culture Of Animal Cells (R. I. Freshney, Alan R. Liss, Inc., 1987); Immobilized Cells And Enzymes (IRL Press, 1986); B. Perbal, A Practical Guide To Molecular Cloning (1984); the treatise, Methods In Enzymology (Academic Press, Inc., N.Y.); Gene Transfer Vectors For Mammalian Cells (J. H. Miller and M. P. Calos eds., 1987, Cold Spring Harbor Laboratory); Methods In Enzymology, Vols. 154 and 155 (Wu et al. eds.), Immunochemical Methods In Cell And Molecular Biology (Mayer and Walker, eds., Academic Press, London, 1987); Handbook Of Experimental Immunology, Volumes I-IV (D. M. Weir and C. C. Blackwell, eds., 1986); Riott, Essential Immunology, 6th Edition, Blackwell Scientific Publications, Oxford, 1988; Hogan et al., Manipulating the Mouse Embryo, (Cold Spring Harbor Laboratory Press, Cold Spring Harbor, N.Y., 1986); Westerfield, M., The zebrafish book. A guide for the laboratory use of zebrafish (Danio rerio), (4th Ed., Univ. of Oregon Press, Eugene, 2000).

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

The present invention is described by reference to the following Examples, which are offered by way of illustration and are not intended to limit the invention in any manner. Standard techniques well known in the art or the techniques specifically described below were utilized.

Example 1: Preparation of Double-Stranded RNA Oligonucleotides

Oligonucleotide Synthesis and Purification

DsiRNA molecules were designed to interact with various sites in the RNA message, for example, target sequences within the RNA sequences described herein. In presently exemplified agents, 384 human target AT3 sequences were selected for evaluation (a selection of the 384 human target AT3 sites were predicted to be conserved with corresponding sites in the mouse He (corresponding to human AT3) transcript sequence). The sequences of one strand of the DsiRNA molecules were complementary to the target AT3 site sequences described above. The DsiRNA molecules were chemically synthesized using methods described herein. Generally, DsiRNA constructs were synthesized using solid phase oligonucleotide synthesis methods as described for 19-23mer siRNAs (see for example Usman et al., U.S. Pat. Nos. 5,804,683; 5,831,071; 5,998,203; 6,117,657; 6,353,098; 6,362,323; 6,437,117; 6,469,158; Scaringe et al., U.S. Pat. Nos. 6,111,086; 6,008,400; 6,111,086).

Individual RNA strands were synthesized and HPLC purified according to standard methods (Integrated DNA Technologies, Coralville, Iowa). For example, RNA oligonucleotides were synthesized using solid phase phosphoramidite chemistry, deprotected and desalted on NAP-5 columns (Amersham Pharmacia Biotech, Piscataway, N.J.) using standard techniques (Damha and Olgivie, 1993, *Methods Mol Biol* 20: 81-114; Wincott et al., 1995, *Nucleic Acids Res* 23: 2677-84). The oligomers were purified using ion-exchange high performance liquid chromatography (IE-HPLC) on an Amersham Source 15Q column (1.0 cm×25 cm; Amersham Pharmacia Biotech, Piscataway, N.J.) using a 15 min step-linear gradient. The gradient varied from 90:10 Buffers A:B to 52:48 Buffers A:B, where Buffer A was 100 mM Tris pH 8.5 and Buffer B was 100 mM Tris pH 8.5, 1 M NaCl. Samples were monitored at 260 nm and peaks corresponding to the full-length oligonucleotide species were collected, pooled, desalted on NAP-5 columns, and lyophilized.

The purity of each oligomer was determined by capillary electrophoresis (CE) on a Beckman PACE 5000 (Beckman Coulter, Inc., Fullerton, Calif.). The CE capillaries had a 100 μm inner diameter and contained ssDNA 100R Gel (Beckman-Coulter). Typically, about 0.6 nmole of oligonucleotide was injected into a capillary, run in an electric field of 444 V/cm and detected by UV absorbance at 260 nm. Denaturing Tris-Borate-7 M-urea running buffer was purchased from Beckman-Coulter. Oligoribonucleotides were obtained that were at least 90% pure as assessed by CE for use in experiments described below. Compound identity was verified by matrix-assisted laser desorption ionization time-of-flight (MALDI-TOF) mass spectroscopy on a Voyager DE™ Biospectometry Work Station (Applied Biosystems, Foster City, Calif.) following the manufacturer's recommended protocol. Relative molecular masses of all oligomers were obtained, often within 0.2% of expected molecular mass.

Preparation of Duplexes

Single-stranded RNA (ssRNA) oligomers were resuspended, e.g., at 100 μM concentration in duplex buffer consisting of 100 mM potassium acetate, 30 mM HEPES, pH 7.5. Complementary sense and antisense strands were mixed in equal molar amounts to yield a final solution of, e.g., 50 μM duplex. Samples were heated to 100° C. for 5' in RNA buffer (IDT) and allowed to cool to room temperature before use. Double-stranded RNA (dsRNA) oligomers were stored at −20° C. Single-stranded RNA oligomers were stored lyophilized or in nuclease-free water at −80° C.

Nomenclature

For consistency, the following nomenclature has been employed in the instant specification. Names given to duplexes indicate the length of the oligomers and the presence or absence of overhangs. A "25/27" is an asymmetric duplex having a 25 base sense strand and a 27 base antisense strand with a 2-base 3'-overhang. A "27/25" is an asymmetric duplex having a 27 base sense strand and a 25 base antisense strand.

Cell Culture and RNA Transfection

Target RNA knockdown was typically measured using the following procedures: HepG2 cells were obtained and maintained in DMEM (HyClone) supplemented with 10% fetal bovine serum (HyClone) at 37° C. under 5% CO2. H36.12J cells were obtained and maintained in DMEM+15% FBS. For RNA transfections, cells were transfected with DsiRNAs at a final concentration of 1 nM, 0.1 nM or 0.03 nM using Lipofectamine™ RNAiMAX (Invitrogen) and following manufacturer's instructions. Briefly, for 0.1 nM transfections, e.g., of Example 3 below, an aliquot of stock solution of each DsiRNA was mixed with Opti-MEM I (Invitrogen) and Lipofectamine™ RNAiMAX to reach an appropriate volume (e.g., a volume of 175 μL (e.g., with 0.3 nM DsiRNA)). The resulting, e.g., 175 μL mix was incubated for sufficient time (e.g., 20 min at RT) to allow DsiRNA:Lipofectamine™ RNAiMAX complexes to form. Meanwhile, target cells were trypsinized and resuspended in medium. At the end of the complexation step, an appropriate amount (e.g., 50 μL) of the DsiRNA:RNAiMAX mixture was added per well into triplicate wells of 96 well plates. Finally, an appropriate amount (e.g., 100 μL) of the cell suspension was added to each well (e.g., final volume 150 μL) and plates were placed into the incubator for 24 hours.

Assessment of AT3 Inhibition

AT3 target gene knockdown in human HepG2 cells and in mouse H36.12J cells was determined by qRT-PCR, with values normalized to HPRT and SFRS9 housekeeping genes in human HepG2 cells or to HPRT and RPL23 housekeeping genes in mouse H36.12J cells, and to transfections with control DsiRNAs and/or mock transfection controls.

RNA Isolation and Analysis

Media was aspirated, and total RNA was extracted using the SV96 kit (Promega). Total RNA was reverse-transcribed using SuperscriptII, Oligo dT, and random hexamers following manufacturer's instructions. Typically, the resulting cDNA was analyzed by qPCR using primers and probes specific for both the AT3 gene and for the mouse genes HPRT-1 and RPL23. An ABI 7700 was used for the amplification reactions. Each sample was tested in triplicate. Relative AT3 RNA levels were normalized to HPRT1 and RPL23 RNA levels and compared with RNA levels obtained in transfection control samples.

Example 2: DsiRNA Inhibition of AT3

DsiRNA molecules targeting AT3 were designed and synthesized as described above and tested in human HepG2 cells (alternatively, HeLa or other human cells could have been used) for inhibitory efficacy. For transfection, annealed DsiRNAs were mixed with the transfection reagent (Lipofectamine™ RNAiMAX, Invitrogen) and incubated for 20 minutes at room temperature. The HepG2 (human) or H36.12J (mouse) cells (alternatively, mouse AML12 or other mouse cells could have been used) were trypsinized, resuspended in media, and added to wells (100 uL per well) to give a final DsiRNA concentration of 1 nM in a volume of 150 μl. Each DsiRNA transfection mixture was added to 3 wells for triplicate DsiRNA treatments. Cells were incubated at 37° C. for 24 hours in the continued presence of the DsiRNA transfection mixture. At 24 hours, RNA was prepared from each well of treated human or mouse cells. For such cells, the supernatants with the transfection mixtures were first removed and discarded, then the cells were lysed and RNA was prepared from each well. AT3/SERPINC1 RNA levels post-treatment were evaluated by qRT-PCR for the AT3 target gene, with values normalized to those obtained for controls. Triplicate data was averaged and the % error was determined for each treatment. Normalized data were both tabulated and graphed, and the reduction of target mRNA by active DsiRNAs in comparison to controls was determined (see Table 7 below and FIGS. 2A to 2L).

TABLE 7

AT3 Inhibitory Efficacy of DsiRNAs Assayed at 1 nM in Human HepG2 and Mouse H36.12J Cells

| | | | Human-HepG2 Normalized to HPRT/SFRS9; vs NC1, NC5, NC7 | | Mouse-H36.12J Normalized HPRT/RPL23; vs NC1, NC5, NC7 | |
| --- | --- | --- | --- | --- | --- | --- |
| Duplex Name | Mm Location | Macaque* Location | Hs 63-186 (FAM) Assay % Remaining | Hs 1218-1315 (HEX) Assay % Remaining | Mm 852-1001 (FAM) Assay % Remaining | Mm 1554-1655 (HEX) Assay % Remaining |
| AT3-142 | | 72 | 6.7 ± 11.6 | 7.6 ± 15 | | |
| AT3-143 | | 73 | 5.9 ± 10.7 | 7.7 ± 15 | | |
| AT3-144 | | 74 | 7.9 ± 16.5 | 8.7 ± 9.3 | | |
| AT3-145 | | 75 | 4.7 ± 3.9 | 4.9 ± 6.3 | | |
| AT3-146 | | 76 | 6.4 ± 17.8 | 7.1 ± 17.5 | | |
| AT3-147 | | 77 | 6.3 ± 4.5 | 7.8 ± 5.7 | | |
| AT3-148 | | 78 | 5.3 ± 9.3 | 6.7 ± 3.9 | | |

TABLE 7-continued

AT3 Inhibitory Efficacy of DsiRNAs Assayed at 1 nM in Human HepG2 and Mouse H36.12J Cells

| Duplex Name | Mm Location | Macaque* Location | Human-HepG2 Normalized to HPRT/SFRS9; vs NC1, NC5, NC7 | | Mouse-H36.12J Normalized HPRT/RPL23; vs NC1, NC5, NC7 | |
|---|---|---|---|---|---|---|
| | | | Hs 63-186 (FAM) Assay % Remaining | Hs 1218-1315 (HEX) Assay % Remaining | Mm 852-1001 (FAM) Assay % Remaining | Mm 1554-1655 (HEX) Assay % Remaining |
| AT3-173 | | 103 | 7.9 ± 10.5 | 9.2 ± 14.1 | | |
| AT3-174 | | 104 | 6.5 ± 4.7 | 8.8 ± 5.3 | | |
| AT3-175 | | 105 | 11.8 ± 35.3 | 16.1 ± 33.3 | | |
| AT3-177 | | 107 | 7.8 ± 1.9 | 9.8 ± 4.3 | | |
| AT3-178 | | 108 | 7 ± 5.5 | 8.5 ± 5.4 | | |
| AT3-179 | | 109 | 7.2 ± 2.7 | 8.8 ± 4 | | |
| AT3-284 | | 214 | 9.3 ± 30.4 | 8.8 ± 26.6 | | |
| AT3-285 | | 215 | 11.2 ± 49.8 | 11.8 ± 49.6 | | |
| AT3-288 | | 218 | 8.6 ± 3.8 | 7.8 ± 5.9 | | |
| AT3-403 | | 333 | 11.8 ± 2.6 | 10.3 ± 11.5 | | |
| AT3-406 | | 336 | 9.4 ± 2.7 | 9.7 ± 5.6 | | |
| AT3-407 | | 337 | 9.4 ± 14.2 | 9.7 ± 12.5 | | |
| AT3-408 | | 338 | 9 ± 4.8 | 9 ± 8 | | |
| AT3-409 | | 339 | 9.4 ± 1.6 | 8.6 ± 2.9 | | |
| AT3-410 | | 340 | 6.4 ± 2.3 | 6.6 ± 2.1 | | |
| AT3-411 | | 341 | 18.9 ± 8 | 18.9 ± 9.5 | | |
| AT3-412 | | 342 | 14.5 ± 11.4 | 14.9 ± 7.1 | | |
| AT3-413 | | 343 | 29.4 ± 6.7 | 25.4 ± 9.3 | | |
| AT3-414 | | 344 | 11 ± 16.5 | 10.4 ± 16.8 | | |
| AT3-433 | | 363 | 27.4 ± 4.7 | 25.5 ± 4.2 | | |
| AT3-459 | | 389 | 85.7 ± 3.5 | 78.9 ± 4.1 | | |
| AT3-462 | | 392 | 30.1 ± 2.3 | 27.9 ± 3.5 | | |
| AT3-464 | | 394 | 14.8 ± 7.9 | 15 ± 9.1 | | |
| AT3-538 | | 468 | 15.2 ± 3.3 | 12.9 ± 3.5 | | |
| AT3-539 | | 469 | 27.4 ± 8.7 | 22.8 ± 10 | | |
| AT3-540 | | 470 | 17.5 ± 5.3 | 13 ± 2.8 | | |
| AT3-541 | | 471 | 29.2 ± 6.1 | 24.4 ± 5.8 | | |
| AT3-542 | | 472 | 85.7 ± 1.3 | 79.7 ± 1.9 | | |
| AT3-543 | | 473 | 17.5 ± 5.5 | 13.9 ± 2.2 | | |
| AT3-544 | | 474 | 26 ± 1.5 | 20.3 ± 2.8 | | |
| AT3-545 | | 475 | 33.6 ± 6.3 | 27.6 ± 1.3 | | |
| AT3-546 | | 476 | 15.7 ± 5.3 | 12.1 ± 5.2 | | |
| AT3-547 | | 477 | 31.2 ± 2.1 | 25.1 ± 1.7 | | |
| AT3-548 | | 478 | 32.2 ± 4.5 | 21.7 ± 16.7 | | |
| AT3-549 | | 479 | 27.5 ± 3.1 | 22.4 ± 2.3 | | |
| AT3-550 | | 480 | 39.3 ± 2 | 32.9 ± 2.9 | | |
| AT3-551 | | 481 | 20.3 ± 3.4 | 17.6 ± 6.1 | | |
| AT3-552 | | 482 | 27.3 ± 5.1 | 23.7 ± 8.6 | | |
| AT3-553 | | 483 | 12.5 ± 4.4 | 9.3 ± 4.5 | | |
| AT3-554 | | 484 | 24.7 ± 4.9 | 21 ± 5 | | |
| AT3-555 | | 485 | 91.6 ± 3.9 | 84.2 ± 3.6 | | |
| AT3-556 | | 486 | 69.4 ± 3.2 | 58.2 ± 3.1 | | |
| AT3-557 | | 487 | 23.5 ± 6 | 18.6 ± 6.2 | | |
| AT3-558 | | 488 | 9.7 ± 9.1 | 7 ± 12.7 | | |
| AT3-559 | | 489 | 11.3 ± 10.6 | 7.8 ± 8.6 | | |
| AT3-560 | | 490 | 44.6 ± 8 | 37.8 ± 4.1 | | |
| AT3-561 | | 491 | 20.8 ± 3 | 18 ± 7 | | |
| AT3-562 | | 492 | 25.6 ± 4.3 | 18.5 ± 4.2 | | |
| AT3-563 | | 493 | 32.5 ± 4.7 | 23.8 ± 3.1 | | |
| AT3-564 | | 494 | 70.8 ± 2 | 63.5 ± 2.6 | | |
| AT3-565 | | 495 | 15.9 ± 20.6 | 11.6 ± 23.8 | | |
| AT3-566 | | 496 | 13 ± 2.6 | 10.4 ± 3.6 | | |
| AT3-567 | | 497 | 28.7 ± 3.8 | 23 ± 2.7 | | |
| AT3-568 | | 498 | 24.5 ± 5.2 | 20.2 ± 3.3 | | |
| AT3-569 | | 499 | 11.7 ± 2.8 | 9 ± 5 | | |
| AT3-570 | | 500 | 13.4 ± 3.6 | 8.9 ± 2.4 | | |
| AT3-571 | | 501 | 13.7 ± 6.8 | 10 ± 4.2 | | |
| AT3-574 | | 504 | 45.4 ± 4.8 | 34.8 ± 15.1 | | |
| AT3-575 | | 505 | 12.3 ± 5.2 | 8.4 ± 9 | | |
| AT3-576 | | 506 | 16.9 ± 13.7 | 12.7 ± 14.7 | | |
| AT3-577 | | 507 | 11.7 ± 2.4 | 8.9 ± 3 | | |
| AT3-589 | | 519 | 14.4 ± 6.2 | 10.7 ± 5.3 | | |
| AT3-635 | | 565 | 15.1 ± 5.6 | 11.3 ± 9.7 | | |
| AT3-636 | | 566 | 24.8 ± 9.7 | 20.7 ± 9.3 | | |
| AT3-639 | | 569 | 36.6 ± 6.1 | 31 ± 4.6 | | |
| AT3-640 | | 570 | 14.7 ± 3.3 | 10.7 ± 3.3 | | |

TABLE 7-continued

AT3 Inhibitory Efficacy of DsiRNAs Assayed at 1 nM in Human HepG2 and Mouse H36.12J Cells

| Duplex Name | Mm Location | Macaque* Location | Human-HepG2 Normalized to HPRT/SFRS9; vs NC1, NC5, NC7 | | Mouse-H36.12J Normalized HPRT/RPL23; vs NC1, NC5, NC7 | |
|---|---|---|---|---|---|---|
| | | | Hs 63-186 (FAM) Assay % Remaining | Hs 1218-1315 (HEX) Assay % Remaining | Mm 852-1001 (FAM) Assay % Remaining | Mm 1554-1655 (HEX) Assay % Remaining |
| AT3-641 | | 571 | 21.2 ± 5.6 | 17.4 ± 7.4 | | |
| AT3-642 | | 572 | 20.5 ± 3 | 16 ± 2.7 | | |
| AT3-643 | | 573 | 20.1 ± 3.1 | 16.1 ± 4.1 | | |
| AT3-644 | | 574 | 20.1 ± 7.7 | 15.1 ± 6.7 | | |
| AT3-655 | | 585 | 44.7 ± 16.2 | 39.8 ± 20.6 | | |
| AT3-659 | | 589 | 17 ± 14.8 | 13.4 ± 16.2 | | |
| AT3-664 | | 594 | 42.3 ± 5.3 | 37 ± 3.8 | | |
| AT3-665 | | 595 | 25.2 ± 4.9 | 21.2 ± 3.5 | | |
| AT3-666 | | 596 | 17 ± 23.4 | 13.8 ± 28.2 | | |
| AT3-670 | | 600 | 15.2 ± 11.9 | 12.2 ± 13.8 | | |
| AT3-680 | | 610 | 34.2 ± 8.3 | 28.9 ± 10.7 | | |
| AT3-681 | | 611 | 17.1 ± 1.8 | 13.1 ± 1.9 | | |
| AT3-682 | | 612 | 21.5 ± 2.8 | 18 ± 3.2 | | |
| AT3-683 | | 613 | 18.9 ± 2.1 | 14.3 ± 3.5 | | |
| AT3-684 | | 614 | 31.1 ± 3.1 | 26 ± 3.6 | | |
| AT3-685 | | 615 | 19.2 ± 5 | 13.6 ± 10.6 | | |
| AT3-687 | | 617 | 24.5 ± 14.2 | 21.3 ± 15.4 | | |
| AT3-688 | | 618 | 46.9 ± 4.8 | 40.3 ± 3.7 | | |
| AT3-689 | | 619 | 15 ± 11.3 | 11.5 ± 11.4 | | |
| AT3-696 | | 626 | 17.5 ± 2.9 | 15.8 ± 2.4 | | |
| AT3-700 | | 630 | 51.8 ± 7.1 | 45.4 ± 7.4 | | |
| AT3-701 | | 631 | 20.5 ± 4.3 | 16.2 ± 5.9 | | |
| AT3-702 | | 632 | 31.3 ± 6.7 | 26.4 ± 6 | | |
| AT3-704 | | 634 | 43.3 ± 8.6 | 37 ± 7 | | |
| AT3-706 | | 636 | 36.4 ± 5.3 | 33.8 ± 4.3 | | |
| AT3-710 | | 640 | 76.8 ± 3.4 | 64.4 ± 3.6 | | |
| AT3-711 | | 641 | 20.2 ± 7.2 | 16 ± 7.3 | | |
| AT3-712 | | 642 | 24 ± 6.1 | 19.8 ± 6.1 | | |
| AT3-713 | | 643 | 38.6 ± 4.8 | 32.6 ± 3 | | |
| AT3-714 | | 644 | 32.9 ± 8.9 | 27.5 ± 8.5 | | |
| AT3-715 | | 645 | 16.3 ± 5.8 | 11.4 ± 5.3 | | |
| AT3-716 | | 646 | 16.2 ± 8.8 | 12.4 ± 4.8 | | |
| AT3-717 | | 647 | 37.4 ± 16.4 | 33.5 ± 17.1 | | |
| AT3-718 | | 648 | 19.6 ± 3.7 | 15.7 ± 5.1 | | |
| AT3-752 | | 682 | 32.5 ± 6 | 27.5 ± 9.5 | | |
| AT3-757 | | 687 | 28.8 ± 6.6 | 23.4 ± 4.5 | | |
| AT3-758 | | 688 | 52.4 ± 5.7 | 45.4 ± 5.9 | | |
| AT3-759 | | 689 | 37.5 ± 5.6 | 32.1 ± 6.7 | | |
| AT3-760 | | 690 | 29.7 ± 6.1 | 24.3 ± 5.1 | | |
| AT3-762 | | 692 | 23.2 ± 5.7 | 18.2 ± 4.3 | | |
| AT3-763 | | 693 | 18.9 ± 4.7 | 16.4 ± 2.3 | | |
| AT3-764 | | 694 | 23.2 ± 6 | 18.4 ± 7.4 | | |
| AT3-765 | | 695 | 33.9 ± 3.5 | 28.3 ± 3.8 | | |
| AT3-794 | | 724 | 25.5 ± 5.3 | 20.4 ± 3.8 | | |
| AT3-795 | | 725 | 21 ± 5.2 | 19.5 ± 1.8 | | |
| AT3-800 | | 730 | 15.2 ± 9.4 | 12.7 ± 9.2 | | |
| AT3-864 | | 794 | 62.7 ± 3 | 58.1 ± 3.3 | | |
| AT3-866 | | 796 | 80.4 ± 4.7 | 79.4 ± 5.8 | | |
| AT3-867 | | 797 | 25.1 ± 4.7 | 23 ± 4.5 | | |
| AT3-868 | | 798 | 37.7 ± 5.9 | 32.7 ± 2.7 | | |
| AT3-869 | | 799 | 55.4 ± 5.2 | 47.9 ± 7.5 | | |
| AT3-870 | | 800 | 18.7 ± 8.1 | 15.2 ± 9.8 | | |
| AT3-871 | | 801 | 22.1 ± 8 | 19.5 ± 6.9 | | |
| AT3-872 | | 802 | 44.3 ± 2.9 | 39 ± 2 | | |
| AT3-873 | | 803 | 78.2 ± 6.4 | 74.8 ± 6.3 | | |
| AT3-874 | | 804 | 17.4 ± 2.9 | 14 ± 3.6 | | |
| AT3-875 | | 805 | 74.1 ± 9.3 | 71.8 ± 9 | | |
| AT3-876 | | 806 | 42.3 ± 6.7 | 39 ± 6.1 | | |
| AT3-877 | | 807 | 29.4 ± 10.5 | 25.4 ± 16.1 | | |
| AT3-878 | | 808 | 48 ± 3.1 | 43.7 ± 1.3 | | |
| AT3-879 | | 809 | 18 ± 3.9 | 13.9 ± 6 | | |
| AT3-880 | | 810 | 41.7 ± 8.2 | 35.4 ± 6.8 | | |
| AT3-881 | | 811 | 32.4 ± 5.2 | 26.6 ± 2.2 | | |
| AT3-959 | | 889 | 16.2 ± 4 | 11.7 ± 11.3 | | |
| AT3-966 | | 896 | 11.5 ± 4.4 | 8.8 ± 2.9 | | |
| AT3-967 | | 897 | 14.7 ± 9.7 | 12.2 ± 11.8 | | |

TABLE 7-continued

AT3 Inhibitory Efficacy of DsiRNAs Assayed at 1 nM in Human HepG2 and Mouse H36.12J Cells

| Duplex Name | Mm Location | Macaque* Location | Human-HepG2 Normalized to HPRT/SFRS9; vs NC1, NC5, NC7 | | Mouse-H36.12J Normalized HPRT/RPL23; vs NC1, NC5, NC7 | |
|---|---|---|---|---|---|---|
| | | | Hs 63-186 (FAM) Assay % Remaining | Hs 1218-1315 (HEX) Assay % Remaining | Mm 852-1001 (FAM) Assay % Remaining | Mm 1554-1655 (HEX) Assay % Remaining |
| AT3-993 | | 923 | 23.5 ± 1.1 | 20.4 ± 1.9 | | |
| AT3-1040 | | 970 | 44.7 ± 3.2 | 41.2 ± 0.9 | | |
| AT3-1043 | | 973 | 21.7 ± 4.1 | 21.4 ± 5.4 | | |
| AT3-1044 | | 974 | 45.4 ± 6 | 43.9 ± 4.8 | | |
| AT3-1045 | | 975 | 19.6 ± 3.8 | 19.2 ± 5 | | |
| AT3-1065 | | 995 | 41.4 ± 9.3 | 33.2 ± 6.5 | | |
| AT3-1066 | | 996 | N/A | N/A | | |
| AT3-1227 | | 1157 | 13.7 ± 3.9 | 12.3 ± 3.4 | | |
| AT3-1228 | | 1158 | 56.1 ± 1.6 | 55.5 ± 7.1 | | |
| AT3-1258 | | 1188 | 36.6 ± N/A | 32.7 ± N/A | | |
| AT3-1260 | | 1190 | 61.6 ± N/A | 56.4 ± N/A | | |
| AT3-1261 | | 1191 | 19.5 ± N/A | 14.9 ± N/A | | |
| AT3-1263 | | 1193 | N/A | N/A | | |
| AT3-1266 | | 1196 | 19.5 ± 10.3 | 15.1 ± 8.1 | | |
| AT3-1268 | | 1198 | 78.6 ± 8.7 | 67.7 ± 9.5 | | |
| AT3-1280 | | 1210 | 19.6 ± 6 | 14.1 ± 3.6 | | |
| AT3-1281 | | 1211 | 6.7 ± 6.4 | 3.6 ± 9.5 | | |
| AT3-1283 | | 1213 | 43.4 ± 2.2 | 37.9 ± 4 | | |
| AT3-1285 | | 1215 | 12.4 ± 14.7 | 8.8 ± 13.6 | | |
| AT3-1286 | | 1216 | 32 ± 6 | 27.2 ± 4.8 | | |
| AT3-1287 | | 1217 | 52.7 ± 2.8 | 43.6 ± 4.1 | | |
| AT3-1288 | | 1218 | 24.8 ± 13.9 | 12.8 ± 9.7 | | |
| AT3-1344 | | 1274 | 11.5 ± 5.5 | 7.6 ± 7.4 | | |
| AT3-1345 | | 1275 | 12.8 ± 17.3 | 7.6 ± 16.8 | | |
| AT3-1346 | | 1276 | 14.6 ± 3.8 | 10.8 ± 2.3 | | |
| AT3-1347 | | 1277 | 9.7 ± 7.7 | 6 ± 6.4 | | |
| AT3-1348 | | 1278 | 18.6 ± 13.8 | 14.3 ± 13 | | |
| AT3-1349 | | 1279 | 21.5 ± 4.5 | 15.5 ± 4.6 | | |
| AT3-1358 | | 1288 | 30.9 ± 5.1 | 26.1 ± 7.2 | | |
| AT3-1359 | | 1289 | 41.7 ± 5.6 | 33 ± 5.6 | | |
| AT3-1360 | | 1290 | 34.2 ± 3.3 | 27.5 ± 4.4 | | |
| AT3-1361 | | 1291 | 86.1 ± 8.5 | 80.9 ± 6.4 | | |
| AT3-1362 | | 1292 | 85.3 ± 2.4 | 82.9 ± 2 | | |
| AT3-1363 | | 1293 | 17.3 ± 7.5 | 11.6 ± 6.6 | | |
| AT3-1364 | | 1294 | 63.5 ± 4.6 | 58.6 ± 2.5 | | |
| AT3-1369 | | 1299 | 16.8 ± N/A | 10.9 ± N/A | | |
| AT3-1372 | | 1302 | 67.5 ± 6.7 | 59.9 ± 6.7 | | |
| AT3-1373 | | 1303 | 48.8 ± 10.3 | 47.3 ± 8.5 | | |
| AT3-1381 | | 1311 | 31.2 ± 15.7 | 21.7 ± 15.6 | | |
| AT3-1452 | | 1382 | 28.1 ± 5 | 18.2 ± 5.3 | | |
| AT3-1453 | | 1383 | 42.7 ± 4.6 | 28.2 ± 2.6 | | |
| AT3-1454 | | 1384 | 21.8 ± 8.2 | 13.4 ± 6.3 | | |
| AT3-1455 | | 1385 | 35.2 ± 8.2 | 28.1 ± 3.7 | | |
| AT3-1456 | | 1386 | 34.3 ± 4.1 | 27 ± 3.8 | | |
| AT3-1457 | | 1387 | 57.2 ± 0.8 | 44.9 ± 1.8 | | |
| AT3-1459 | | 1389 | 10.1 ± 3.5 | 4.8 ± 8.5 | | |
| AT3-1460 | | 1390 | 37.4 ± 3.5 | 28.9 ± 2.2 | | |
| AT3-1461 | | 1391 | 14.5 ± 5.7 | 8.1 ± 3 | | |
| AT3-1462 | | 1392 | 40 ± 3.2 | 30.4 ± 2.4 | | |
| AT3-1463 | | 1393 | 24.8 ± 3.2 | 16.2 ± 2.8 | | |
| AT3-1464 | | 1394 | 20.4 ± 2.1 | 14.5 ± 5.3 | | |
| AT3-1465 | | 1395 | 13.8 ± 4.5 | 7.1 ± 3.1 | | |
| AT3-1466 | | 1396 | 26.5 ± 3.4 | 18.8 ± 2.2 | | |
| AT3-1467 | | 1397 | 37.9 ± 1.9 | 31.4 ± 2.1 | | |
| AT3-1468 | | 1398 | 46.1 ± 1.4 | 39.8 ± 2.5 | | |
| AT3-1469 | | 1399 | 74.3 ± 2.7 | 67.2 ± 2.6 | | |
| AT3-1470 | | 1400 | 34.7 ± 2 | 31 ± 1.9 | | |
| AT3-1471 | | 1401 | 58.3 ± 4 | 52.6 ± 2.9 | | |
| AT3-1472 | | 1402 | 31.7 ± 4.6 | 27.4 ± 1.2 | | |
| AT3-1473 | | 1403 | 13.2 ± 2.5 | 9.7 ± 2.7 | | |
| AT3-1474 | | 1404 | 40.9 ± N/A | 35 ± N/A | | |
| AT3-1475 | | 1405 | 8.6 ± 4.2 | 5.3 ± 8.1 | | |
| AT3-1476 | | 1406 | 12.3 ± 14.3 | 8.3 ± 15.9 | | |
| AT3-1477 | | 1407 | 19.6 ± 5.3 | 14.6 ± 7.4 | | |
| AT3-1478 | | 1408 | 10.3 ± 3.1 | 5.7 ± 3.1 | | |
| AT3-1479 | | 1409 | 11.6 ± 4.6 | 6 ± 2.9 | | |

TABLE 7-continued

AT3 Inhibitory Efficacy of DsiRNAs Assayed at 1 nM in Human HepG2 and Mouse H36.12J Cells

| Duplex Name | Mm Location | Macaque* Location | Human-HepG2 Normalized to HPRT/SFRS9; vs NC1, NC5, NC7 | | Mouse-H36.12J Normalized HPRT/RPL23; vs NC1, NC5, NC7 | |
|---|---|---|---|---|---|---|
| | | | Hs 63-186 (FAM) Assay % Remaining | Hs 1218-1315 (HEX) Assay % Remaining | Mm 852-1001 (FAM) Assay % Remaining | Mm 1554-1655 (HEX) Assay % Remaining |
| AT3-1480 | | 1410 | 10.5 ± 9.7 | 6.5 ± 8.4 | | |
| AT3-1481 | | 1411 | 12.1 ± 1.7 | 6 ± 5.1 | | |
| AT3-1482 | | 1412 | 35.1 ± 2.7 | 30.3 ± 4.1 | | |
| AT3-1483 | | 1413 | 13.7 ± 6.6 | 8.5 ± 17.6 | | |
| AT3-1484 | | 1414 | 25.2 ± 2.8 | 20 ± 2.8 | | |
| AT3-1485 | | 1415 | 10.2 ± 3.4 | 4.6 ± 2.4 | | |
| AT3-1486 | | 1416 | 8.9 ± 6.7 | 5.4 ± 8.3 | | |
| AT3-1488 | | 1418 | 10 ± 1.6 | 5.6 ± 6.1 | | |
| AT3-1493 | | 1423 | 7.5 ± 7.7 | 4.3 ± 8.6 | | |
| AT3-1584 | | 1513 | 10.3 ± 1.7 | 7.2 ± 3.2 | | |
| AT3-1585 | | 1514 | 12.8 ± 4.2 | 9.5 ± 3.5 | | |
| | AT3-m78 | | 134.7 ± 2.3 | 129 ± 2.6 | 109.5 ± 4.7 | 101.1 ± 5.3 |
| | AT3-m634 | | 224 ± 9 | 184.7 ± 7 | 117.1 ± 6.4 | 104 ± 4.5 |
| | AT3-m642 | | 73.9 ± 2.8 | 71.3 ± 3.1 | 105.2 ± 4.1 | 102.7 ± 6.8 |
| | AT3-m1574 | | 62.1 ± 3.8 | 60.8 ± 5.8 | 48.1 ± 8.9 | 43.5 ± 11.8 |
| | AT3-m1577 | | 86.6 ± 16.5 | 77.1 ± 16 | 33.2 ± 10.9 | 32.9 ± 5.8 |
| | AT3-m1579 | | 52.6 ± 2.5 | 48.3 ± 3.7 | 31.4 ± 25.1 | 31.1 ± 7.5 |
| | AT3-m1664 | | 68.7 ± 7.2 | 76.2 ± 6 | 31 ± 9.9 | 26.7 ± 5.5 |
| | AT3-m1668 | | 96.6 ± 1.7 | 96.3 ± 2.4 | 59.9 ± 4.3 | 44.7 ± 5.1 |
| | AT3-m1669 | | 83.4 ± 3.1 | 72.7 ± 2.8 | 39.7 ± 8.3 | 37.1 ± 10.4 |
| | AT3-m1670 | | 30.3 ± 15.6 | 25.4 ± 14.6 | 38.3 ± 3.8 | 37.5 ± 7.2 |
| | AT3-m1671 | | 23.6 ± 14.7 | 19.2 ± 14.6 | 43.1 ± 9.5 | 43.4 ± 6.2 |
| | AT3-m1675 | | 10.3 ± 9.2 | 7.6 ± 13.4 | 55.6 ± 10.5 | 52.8 ± 9.5 |
| | AT3-m1949 | | 88.6 ± 24.1 | 89 ± 20.3 | 93.5 ± 1.9 | 91.6 ± 2 |
| | AT3-m2166 | | 70.7 ± 3.9 | 73.9 ± 6.3 | 100.3 ± 4.2 | 94.1 ± 2.7 |
| AT3-298 | 394 | 228 | 33 ± 4.5 | 36.6 ± 3.8 | 122.3 ± 11.9 | 96.1 ± 6.6 |
| AT3-381 | 477 | 311 | 96.3 ± 10 | 109.2 ± 2.7 | 118.9 ± 4.1 | 92.6 ± 3.1 |
| AT3-382 | 478 | 312 | 73.1 ± 7.3 | 78.7 ± 5 | 111.4 ± 13.6 | 90.9 ± 4.3 |
| AT3-383 | 479 | 313 | 73.1 ± 17.6 | 79.4 ± 6.1 | 144.1 ± 6.2 | 93.5 ± 5 |
| AT3-384 | 480 | 314 | 35.2 ± 2.4 | 37.9 ± 7 | 133.3 ± 2.4 | 94.7 ± 5.4 |
| AT3-385 | 481 | 315 | 49.6 ± 8.1 | 57.9 ± 5.7 | 106.7 ± 12 | 97.4 ± 3.4 |
| AT3-386 | 482 | 316 | 58.8 ± 2.5 | 59.3 ± 2 | 117.2 ± 4.8 | 98.8 ± 5.6 |
| AT3-387 | 483 | 317 | 41.7 ± 1.8 | 43.3 ± 1.8 | 131.6 ± 2.6 | 106.6 ± 2 |
| AT3-388 | 484 | 318 | 73 ± 7.6 | 73.2 ± 7 | 108.6 ± 6.7 | 101.8 ± 1.9 |
| AT3-495 | 591 | 425 | 21.3 ± 2.5 | 20.3 ± 5.3 | 120.9 ± 6.5 | 96.9 ± 5.4 |
| AT3-496 | 592 | 426 | 32.1 ± 2 | 32.4 ± 3.5 | 136.6 ± 13 | 97 ± 5.2 |
| AT3-497 | 593 | 427 | 69 ± 3.7 | 69.6 ± 3.5 | 140.8 ± 1.3 | 95.8 ± 3.7 |
| AT3-498 | 594 | 428 | 75.8 ± 7.6 | 76.2 ± 6 | 110.7 ± 5.9 | 83.9 ± 3.5 |
| AT3-499 | 595 | 429 | 70.6 ± 4.7 | 67.3 ± 3.9 | 122.4 ± 2.6 | 96.3 ± 3.8 |
| AT3-500 | 596 | 430 | 28.4 ± 14.1 | 43.2 ± 22.9 | 80.1 ± 18.6 | 94.7 ± 8.6 |
| AT3-501 | 597 | 431 | 67.9 ± 4.9 | 68.1 ± 3.4 | 124.2 ± 2.7 | 98.7 ± 2.2 |
| AT3-502 | 598 | 432 | 70 ± 6.2 | 65 ± 5.1 | 104.1 ± 9.1 | 100.5 ± 3.4 |
| AT3-503 | 599 | 433 | 58.4 ± 2.6 | 59.9 ± 3.2 | 107.5 ± 12.2 | 98.6 ± 5.4 |
| AT3-504 | 600 | 434 | 11.4 ± 12.6 | 11.6 ± 9.8 | 106.5 ± 1.7 | 98.2 ± 6 |
| AT3-505 | 601 | 435 | 17.5 ± 4.5 | 19.3 ± 3.9 | 131.1 ± 24.4 | 97.4 ± 2.9 |
| AT3-506 | 602 | 436 | 89.9 ± 2.1 | 91.5 ± 0.9 | 110 ± 4 | 90.5 ± 4 |
| AT3-507 | 603 | 437 | 103 ± 2 | 100.5 ± 1.9 | 129 ± 16.7 | 98.9 ± 7.3 |
| AT3-508 | 604 | 438 | 46.2 ± 4.2 | 47.3 ± 6.1 | 106.3 ± 3.3 | 97 ± 2.4 |
| AT3-591 | 687 | 521 | 17.5 ± 14.1 | 15 ± 15.5 | 142.9 ± 10.7 | 89.4 ± 4.6 |
| AT3-592 | 688 | 522 | 21.8 ± 3.5 | 16.1 ± 4.8 | 128.7 ± 5.2 | 90.5 ± 5.5 |
| AT3-593 | 689 | 523 | 31.1 ± 12.5 | 29 ± 10.5 | 111.8 ± 4.9 | 83.4 ± 3.5 |
| AT3-594 | 690 | 524 | 14.4 ± 8.4 | 11 ± 11.7 | 97.6 ± 3.5 | 91.1 ± 3.9 |
| AT3-595 | 691 | 525 | 13.1 ± 6.4 | 9.9 ± 7 | 120.8 ± 6.4 | 93.5 ± 3.4 |
| AT3-596 | 692 | 526 | 39 ± 8.9 | 34.5 ± 6.8 | 93 ± 5.7 | 85.1 ± 4.2 |
| AT3-597 | 693 | 527 | 17 ± 5.2 | 13.8 ± 6.7 | 129.8 ± 16.6 | 121.4 ± 1.2 |
| AT3-598 | 694 | 528 | 23 ± 7.7 | 20.3 ± 4.2 | 89.6 ± 3.4 | 89.9 ± 7.5 |
| AT3-599 | 695 | 529 | 20 ± 2.3 | 17.1 ± 3.2 | 128.3 ± 2.5 | 92.4 ± 3 |
| AT3-600 | 696 | 530 | 13.9 ± 5.6 | 10 ± 7.7 | 131.3 ± 12.4 | 101.4 ± 4.4 |
| AT3-601 | 697 | 531 | 39.2 ± 1.4 | 34.8 ± 2.8 | 123.5 ± 6.3 | 94.9 ± 4.5 |
| AT3-602 | 698 | 532 | 22.5 ± 4.9 | 18.4 ± 3.8 | 108.4 ± 2.4 | 93 ± 2.9 |
| AT3-603 | 699 | 533 | 21.4 ± 3.2 | 18.3 ± 4.6 | 156.8 ± 13.4 | 97.2 ± 7.3 |
| AT3-604 | 700 | 534 | 62.1 ± 3.2 | 56.2 ± 4.9 | 114.5 ± 7.7 | 85.3 ± 6.5 |
| AT3-605 | 701 | 535 | 81.3 ± 6 | 77.3 ± 5.7 | 119.8 ± 3.8 | 94.7 ± 4.6 |
| AT3-606 | 702 | 536 | 17.8 ± 15 | 17.2 ± 4.2 | 101.4 ± 4.9 | 82.7 ± 19.1 |
| AT3-607 | 703 | 537 | 15.3 ± 2.2 | 12.8 ± 1.8 | 135.4 ± 8.3 | 102.2 ± 3.3 |
| AT3-608 | 704 | 538 | 35.2 ± 1.9 | 32.7 ± 2.2 | 126.6 ± 9 | 97 ± 5 |

TABLE 7-continued

AT3 Inhibitory Efficacy of DsiRNAs Assayed at 1 nM in Human HepG2 and Mouse H36.12J Cells

| Duplex Name | Mm Location | Macaque* Location | Human-HepG2 Normalized to HPRT/SFRS9; vs NC1, NC5, NC7 | | Mouse-H36.12J Normalized HPRT/RPL23; vs NC1, NC5, NC7 | |
|---|---|---|---|---|---|---|
| | | | Hs 63-186 (FAM) Assay % Remaining | Hs 1218-1315 (HEX) Assay % Remaining | Mm 852-1001 (FAM) Assay % Remaining | Mm 1554-1655 (HEX) Assay % Remaining |
| AT3-609 | 705 | 539 | 47.9 ± 1.8 | 47.6 ± 2.1 | 122.7 ± 9.5 | 94.8 ± 7.3 |
| AT3-610 | 706 | 540 | 11.8 ± 2.8 | 9 ± 2.9 | 115.9 ± 15.7 | 102.6 ± 8.1 |
| AT3-611 | 707 | 541 | 12.4 ± 4.6 | 10.1 ± 2.5 | 130.5 ± 5.3 | 98.1 ± 8.4 |
| AT3-612 | 708 | 542 | 12.2 ± 3.2 | 12.2 ± 0.4 | 120.6 ± 2.6 | 90.1 ± 5.4 |
| AT3-613 | 709 | 543 | 28.8 ± 6 | 27.5 ± 4.4 | 117.8 ± 2.2 | 90.7 ± 0.7 |
| AT3-614 | 710 | 544 | 71.8 ± 6.3 | 64.8 ± 3 | 78.8 ± 6.2 | 94.6 ± 2.8 |
| AT3-615 | 711 | 545 | 34.2 ± 4.8 | 29.8 ± 4.7 | 142.8 ± 12.9 | 119 ± 4.3 |
| AT3-616 | 712 | 546 | 25.5 ± 5.7 | 20.3 ± 6.7 | 87.2 ± 9.8 | 111.9 ± 4.6 |
| AT3-617 | 713 | 547 | 23.4 ± 7.3 | 20.2 ± 6 | 63.6 ± 0.8 | 95.9 ± 1.9 |
| AT3-618 | 714 | 548 | 11 ± 5 | 7.9 ± 7.7 | 93 ± 6.7 | 100.9 ± 4.6 |
| AT3-619 | 715 | 549 | 10.1 ± 2.7 | 7.2 ± 4.5 | 80.9 ± 13 | 112.8 ± 4.6 |
| AT3-620 | 716 | 550 | 13.6 ± 4.2 | 10.9 ± 5.6 | 67.1 ± 9 | 103 ± 3.2 |
| AT3-621 | 717 | 551 | 39.3 ± 4.1 | 32.4 ± 2.1 | 61.5 ± 12.9 | 110.4 ± 4.9 |
| AT3-622 | 718 | 552 | 66.2 ± 3.9 | 58.1 ± 2.7 | 91.7 ± 5 | 105.4 ± 1.5 |
| AT3-623 | 719 | 553 | 21.2 ± 10.5 | 16.9 ± 6.9 | 125.6 ± 0.9 | 120.3 ± 6.3 |
| AT3-624 | 720 | 554 | 14.3 ± 4.5 | 11.4 ± 1.8 | 88.9 ± 11.6 | 115.9 ± 8.5 |
| AT3-625 | 721 | 555 | 21.6 ± 6.6 | 20.1 ± 5.7 | 98.8 ± 10.7 | 120.7 ± 9 |
| AT3-626 | 722 | 556 | 22.7 ± 8.7 | 19.1 ± 6.4 | 105.1 ± 5.3 | 103.7 ± 2.8 |
| AT3-627 | 723 | 557 | 39.7 ± 3.9 | 37.2 ± 5.7 | 81.6 ± 3.7 | 122.2 ± 3.7 |
| AT3-628 | 724 | 558 | 13.3 ± 8.3 | 11.4 ± 7.1 | 77.1 ± 9 | 93.4 ± 3.5 |
| AT3-672 | 768 | 602 | 21.2 ± 5.3 | 17.6 ± 4.3 | 83.9 ± 5.7 | 113.3 ± 5.1 |
| AT3-673 | 769 | 603 | 29.9 ± 2.2 | 23.5 ± 2.7 | 59.2 ± 13.4 | 96 ± 4.4 |
| AT3-674 | 770 | 604 | 25.9 ± 4.4 | 23.8 ± 4.4 | 115.4 ± 5.6 | 114.7 ± 2.4 |
| AT3-675 | 771 | 605 | 22.7 ± 4.5 | 20.4 ± 3.4 | 79.1 ± 6.7 | 92 ± 7.3 |
| AT3-676 | 772 | 606 | 16 ± 4 | 13.8 ± 5.9 | 87.5 ± 4.2 | 105.3 ± 3.3 |
| AT3-735 | 831 | | 100.7 ± 1.3 | 92.4 ± 1.2 | 106.7 ± 4.1 | 100.8 ± 5.5 |
| AT3-736 | 832 | | 95.6 ± 5 | 92.7 ± 4.1 | 155.9 ± 9.4 | 105.2 ± 3.1 |
| AT3-737 | 833 | | 104.6 ± 6.9 | 95.1 ± 5.2 | 87.7 ± 9.7 | 96.4 ± 3.8 |
| AT3-738 | 834 | 668 | 90.4 ± 0.9 | 81.4 ± 2.9 | 110.5 ± 7.8 | 101.6 ± 6 |
| AT3-739 | 835 | 669 | 62.3 ± 1.7 | 61.3 ± 4.3 | 72.5 ± 18.8 | 114.3 ± 5.7 |
| AT3-740 | 836 | 670 | 84.5 ± 4.7 | 90.2 ± 5.8 | 53.6 ± 8.9 | 89.2 ± 2.8 |
| AT3-741 | 837 | 671 | 54.7 ± 4.8 | 50.5 ± 3.3 | 92.7 ± 5.2 | 124.4 ± 5.1 |
| AT3-742 | 838 | 672 | 77 ± 2.1 | 75.6 ± 5.1 | 131.8 ± 8.6 | 102.9 ± 2.7 |
| AT3-743 | 839 | 673 | 30.3 ± 1.7 | 28.3 ± 4.4 | 163 ± 10.1 | 113.8 ± 6.7 |
| AT3-744 | 840 | 674 | 17.9 ± 5.1 | 15.8 ± 5.2 | 122.8 ± 7.5 | 111.5 ± 3.7 |
| AT3-745 | 841 | 675 | 36.8 ± 3.8 | 36.5 ± 3.5 | 102.2 ± 5.8 | 99 ± 3.4 |
| AT3-746 | 842 | 676 | 82.1 ± 6.2 | 79 ± 10.2 | 97.6 ± 7.3 | 105.2 ± 7.7 |
| AT3-747 | 843 | 677 | 46.4 ± 6 | 42.2 ± 4.8 | 90.8 ± 8.3 | 101.5 ± 3.6 |
| AT3-748 | 844 | 678 | 79.5 ± 4.2 | 77.6 ± 4.3 | 112.3 ± 2.6 | 102 ± 2.1 |
| AT3-749 | 845 | 679 | 90.5 ± 1.4 | 86.2 ± 6.3 | 92.9 ± 4.9 | 111.2 ± 3.8 |
| AT3-750 | 846 | 680 | 61.8 ± 4.2 | 55.9 ± 5.2 | 112.3 ± 7.2 | 97.9 ± 6.4 |
| AT3-751 | 847 | 681 | 70.5 ± 7.2 | 66.4 ± 8.2 | 115.1 ± 4.5 | 102.9 ± 7.3 |
| AT3-882 | 978 | 812 | 8.6 ± 9.6 | 5.8 ± 10.2 | 44.6 ± 10.9 | 54 ± 5.5 |
| AT3-883 | 979 | 813 | 9.6 ± 8 | 7.2 ± 8.4 | 41 ± 11.8 | 48.2 ± 11.5 |
| AT3-884 | 980 | 814 | 19 ± 6.3 | 15 ± 9.4 | 57 ± 8 | 69.5 ± 4.5 |
| AT3-885 | 981 | 815 | 26.4 ± 3.9 | 22.3 ± 2.9 | 57.5 ± 4.8 | 67.5 ± 3.8 |
| AT3-886 | 982 | 816 | 53.9 ± 1.8 | 50.4 ± 2.3 | 85.1 ± 6.3 | 77.7 ± 6.6 |
| AT3-887 | 983 | 817 | 90.2 ± 3.9 | 84.7 ± 5.7 | 88.3 ± 2.7 | 104.9 ± 3.5 |
| AT3-888 | 984 | 818 | 43.8 ± 5.8 | 41.9 ± 8 | 43.6 ± 15.9 | 49.6 ± 4.5 |
| AT3-889 | 985 | 819 | 61.9 ± 3.8 | 59.2 ± 3.4 | 74.7 ± 4 | 77.1 ± 3.4 |
| AT3-890 | 986 | 820 | 32.4 ± 8.2 | 29.7 ± 3.4 | 77.1 ± 6.1 | 74.1 ± 6.9 |
| AT3-891 | 987 | 821 | 25.6 ± 4.5 | 24.4 ± 3.3 | 66.6 ± 4.8 | 65 ± 4.5 |
| AT3-892 | 988 | 822 | 23.3 ± 3.1 | 19.6 ± 3.6 | 49 ± 6.6 | 64.1 ± 2.1 |
| AT3-893 | 989 | 823 | 30.5 ± 2.6 | 28.2 ± 4.1 | 87.9 ± 4.7 | 83.1 ± 6.2 |
| AT3-894 | 990 | 824 | 66.3 ± 3.2 | 62.8 ± 3.7 | 71.8 ± 4.7 | 75.3 ± 3.9 |
| AT3-895 | 991 | 825 | 78.2 ± 4 | 75.2 ± 4.2 | 61.1 ± 12.5 | 77.4 ± 5.4 |
| AT3-896 | 992 | 826 | 46.4 ± 4.8 | 40.4 ± 6.2 | 45.4 ± 8.4 | 72.3 ± 8.1 |
| AT3-897 | 993 | 827 | 24.6 ± 5.7 | 21.1 ± 7.8 | 52.5 ± 9.9 | 63.6 ± 5.7 |
| AT3-898 | 994 | 828 | 50.6 ± 3.7 | 43.8 ± 4.9 | 65.8 ± 1.5 | 71 ± 1.7 |
| AT3-899 | 995 | 829 | 42.6 ± 2.9 | 34.7 ± 3.1 | 59.1 ± 2.2 | 74.8 ± 5.2 |
| AT3-900 | 996 | 830 | 72.7 ± 2.2 | 61.8 ± 4.1 | 49.6 ± 3.4 | 61.8 ± 2.8 |
| AT3-901 | 997 | 831 | 23.9 ± 6.2 | 18.9 ± 2.2 | 35.5 ± 4.9 | 55.9 ± 5.9 |
| AT3-902 | 998 | 832 | 25.1 ± 4.9 | 19.5 ± 4.7 | 49.5 ± 7.1 | 60 ± 4.9 |
| AT3-903 | 999 | 833 | 32.7 ± 0.4 | 26.7 ± 2.1 | 56.6 ± 16.9 | 64.7 ± 4.7 |
| AT3-904 | 1000 | 834 | 40.3 ± 14.1 | 44.8 ± 12.4 | 37.5 ± 6.2 | 65 ± 3.8 |
| AT3-905 | 1001 | 835 | 69 ± 14.8 | 62 ± 15.9 | 84.7 ± 7.5 | 88.2 ± 2.3 |

TABLE 7-continued

AT3 Inhibitory Efficacy of DsiRNAs Assayed at 1 nM in Human HepG2 and Mouse H36.12J Cells

| Duplex Name | Mm Location | Macaque* Location | Human-HepG2 Normalized to HPRT/SFRS9; vs NC1, NC5, NC7 | | Mouse-H36.12J Normalized HPRT/RPL23; vs NC1, NC5, NC7 | |
|---|---|---|---|---|---|---|
| | | | Hs 63-186 (FAM) Assay % Remaining | Hs 1218-1315 (HEX) Assay % Remaining | Mm 852-1001 (FAM) Assay % Remaining | Mm 1554-1655 (HEX) Assay % Remaining |
| AT3-906 | 1002 | 836 | 37.5 ± 7.1 | 31.4 ± 5.6 | 60.7 ± 5.7 | 68.1 ± 5 |
| AT3-907 | 1003 | 837 | 25.5 ± 4.9 | 20.5 ± 3 | 43.8 ± 12.8 | 55.2 ± 4.1 |
| AT3-908 | 1004 | | 9.3 ± 4.1 | 5.6 ± 5.7 | 18.1 ± 14.7 | 31 ± 5 |
| AT3-909 | 1005 | | 14.4 ± 1.5 | 10.6 ± 8.9 | 32.4 ± 7 | 38.2 ± 4.1 |
| AT3-910 | 1006 | | 40.1 ± 5 | 36.5 ± 5.6 | 24.4 ± 4.2 | 43.1 ± 6.4 |
| AT3-911 | 1007 | | 71.9 ± 4.4 | 62.8 ± 6.5 | 49.9 ± 12.4 | 67.4 ± 2.4 |
| AT3-912 | 1008 | | 77.5 ± 4 | 71.9 ± 4.8 | 72.9 ± 11.6 | 72.9 ± 4.6 |
| AT3-913 | 1009 | | 88.6 ± 3.8 | 79.9 ± 2.3 | 69.1 ± 8.8 | 81.3 ± 6 |
| AT3-914 | 1010 | | 98 ± 20.7 | 89.1 ± 19.7 | 79.5 ± 7.9 | 79.1 ± 7 |
| AT3-915 | 1011 | | 30.4 ± 0.5 | 24.1 ± 0.7 | 40.9 ± 7.4 | 54.6 ± 5.4 |
| AT3-916 | 1012 | | 58.5 ± 3.5 | 49.8 ± 1.7 | 66.2 ± 4.2 | 78.7 ± 6 |
| AT3-988 | 1084 | 918 | 72.8 ± 9.4 | 61.3 ± 6.4 | 58.3 ± 5.1 | 74.4 ± 2.6 |
| AT3-989 | 1085 | 919 | 34.2 ± 6.4 | 29 ± 4.3 | 67.6 ± 13.4 | 71.8 ± 3.2 |
| AT3-990 | 1086 | 920 | 12.7 ± 2.2 | 7.9 ± 5.7 | 30.3 ± 15.4 | 43.5 ± 5.7 |
| AT3-991 | 1087 | 921 | 38.6 ± 5.4 | 30.1 ± 2.8 | 36.1 ± 11.4 | 53 ± 2.5 |
| AT3-1093 | 1189 | 1023 | 81 ± 4.5 | 70.1 ± 2.9 | 41.8 ± 25.1 | 51.9 ± 10.3 |
| AT3-1094 | 1190 | 1024 | 76.7 ± 2 | 73 ± 2.3 | 58.3 ± 15.3 | 68.2 ± 3.8 |
| AT3-1095 | 1191 | 1025 | 49.1 ± 1.8 | 46 ± 0.9 | 72 ± 7.8 | 67.5 ± 5.6 |
| AT3-1096 | 1192 | 1026 | 96.1 ± 5.5 | 91.5 ± 4.7 | 85.7 ± 6.4 | 81.7 ± 7.1 |
| AT3-1097 | 1193 | 1027 | 24.4 ± 8.2 | 19.8 ± 4.6 | 40.9 ± 3.3 | 57.7 ± 3 |
| AT3-1098 | 1194 | | 59.9 ± 5.1 | 55.4 ± 2.8 | 65.6 ± 1.9 | 73.2 ± 4.6 |
| AT3-1099 | 1195 | | 66.9 ± 2.9 | 64.1 ± 2 | 62.7 ± 10.6 | 70.3 ± 6.8 |
| AT3-1100 | 1196 | | 64.5 ± 3.6 | 63.1 ± 0.6 | 63.6 ± 12.3 | 64.8 ± 4.8 |
| AT3-1101 | 1197 | | 44.1 ± 1.9 | 46.7 ± 3 | 69 ± 6.7 | 73.2 ± 4.9 |
| AT3-1102 | 1198 | | 75 ± 7.3 | 75.1 ± 5.3 | 80.3 ± 4.6 | 75.8 ± 3.4 |
| AT3-1103 | 1199 | | 79.5 ± 3.4 | 72.7 ± 3.9 | 90 ± 13.1 | 83.4 ± 4.6 |
| AT3-1104 | 1200 | | 64.1 ± 7.1 | 58.3 ± 6 | 91.3 ± 2.6 | 87.8 ± 3.5 |
| AT3-1105 | 1201 | | 36.1 ± 2.8 | 33.7 ± 4.1 | 68.6 ± 8.1 | 70.7 ± 2.2 |
| AT3-1188 | 1284 | | 50.9 ± 6.1 | 47.4 ± 5.2 | 84.3 ± 4.5 | 90.7 ± 5.4 |
| AT3-1189 | 1285 | | 26.7 ± 4.5 | 26 ± 3.8 | 44.4 ± 9.6 | 56.8 ± 1.8 |
| AT3-1190 | 1286 | | 83.9 ± 0.5 | 81.8 ± 2.3 | 88.1 ± 13.6 | 87.6 ± 4.2 |
| AT3-1191 | 1287 | | 55.1 ± 2.1 | 48.1 ± 2 | 78.2 ± 12.5 | 68 ± 4.6 |
| AT3-1192 | 1288 | | 78.3 ± 11.9 | 84.2 ± 6.6 | 125.4 ± 9.4 | 91.1 ± 2.8 |
| AT3-1193 | 1289 | | 52.6 ± 10.6 | 53.2 ± 6.8 | 118.3 ± 6.6 | 75 ± 5.6 |
| AT3-1194 | 1290 | 1124 | 68.5 ± 4.3 | 59.6 ± 3.1 | 72.2 ± 5.9 | 83.5 ± 4.9 |
| AT3-1231 | 1327 | 1161 | 29.8 ± 4.3 | 23.6 ± 5.1 | 42 ± 8.9 | 54.2 ± 2.1 |
| AT3-1232 | 1328 | 1162 | 36.5 ± 2.3 | 28.6 ± 1.9 | 36.6 ± 10.8 | 57.8 ± 4.5 |
| AT3-1233 | 1329 | 1163 | 20.4 ± 15.2 | 17.5 ± 20.6 | 30.6 ± 4.8 | 37.9 ± 2.9 |
| AT3-1234 | 1330 | 1164 | 15.9 ± 6.9 | 12.1 ± 9.9 | 49.9 ± 15.4 | 43.6 ± 7.4 |
| AT3-1235 | 1331 | 1165 | 50.2 ± 4.1 | 44.3 ± 6.7 | 95.1 ± 9.2 | 82.5 ± 7.7 |
| AT3-1236 | 1332 | 1166 | 76.5 ± 4.4 | 70.3 ± 6.6 | 93.9 ± 5.7 | 87.8 ± 7.9 |
| AT3-1237 | 1333 | 1167 | 26.9 ± 13.7 | 22 ± 11.3 | 68.1 ± 13.1 | 74.1 ± 9.9 |
| AT3-1238 | 1334 | 1168 | 43.6 ± 7.9 | 38.1 ± 10.3 | 90.6 ± 5.6 | 82 ± 7.1 |
| AT3-1239 | 1335 | 1169 | 9.2 ± 12.2 | 6 ± 17.5 | 49.5 ± 9.2 | 47.3 ± 7.8 |
| AT3-1240 | 1336 | 1170 | 34.1 ± 8 | 24.8 ± 7.2 | 66.3 ± 8.5 | 62.5 ± 8.6 |
| AT3-1350 | 1446 | 1280 | 32.5 ± 19.3 | 25.8 ± 25.3 | 52.8 ± 7.4 | 56.8 ± 4.8 |
| AT3-1351 | 1447 | 1281 | 18.3 ± 6.7 | 12.9 ± 10.9 | 57.5 ± 4.6 | 48.5 ± 1.3 |

*Macaca mulatta

Example 3: DsiRNA Inhibition of AT3—Secondary Screen 96 asymmetric DsiRNAs (90 targeting Hs AT3, 26 of which also targeted Mm AT3, and six uniquely targeting Mm AT3) of the above experiment were then examined in a secondary assay ("Phase 2"), with results of such assays presented in histogram form in FIGS. 3A to 3H. Specifically, the 96 asymmetric DsiRNAs selected from those tested above were assessed for inhibition of human AT3 at 1 nM or 0.1 nM (in duplicate assays) in the environment of human HepG2 cells (FIGS. 3A to 3D). These 96 asymmetric DsiRNAs were also assessed for inhibition of mouse AT3 at 1 nM or 0.1 nM (in duplicate) in the environment of mouse H36.12J cells (FIGS. 3E to 3H). As shown in FIGS. 3A to 3D, most asymmetric DsiRNAs reproducibly exhibited significant human AT3 inhibitory efficacies at sub-nanomolar concentrations when assayed in the environment of HepG2 cells.

As shown in FIGS. 3E to 3H, a number of asymmetric DsiRNAs were also identified to possess significant mouse AT3 inhibitory efficacies at sub-nanomolar concentrations when assayed in the environment of mouse H36.12J cells. Table 8 provides those hits reconfigured into a tetraloop format, an example of which is shown in FIG. 5 for the "AT3-179-TL" agent (derived from the "AT3-179" DsiRNA

Example 4: Assessment of Modified Forms of AT3-Targeting DsiRNAs In Vitro

A selection of 16 DsiRNAs from Example 3 above were prepared with 2'-O-methyl guide strand modification patterns (e.g., "M17", "M527", "M528", "M529", "M48" and "M8" as shown above), paired with "M107" passenger strand modifications. For each of these DsiRNA sequences, DsiRNAs possessing each of the six guide strand modification patterns M17, M527, M528, M529, M48 and M8 coupled with the "M107" passenger strand modification pattern were assayed for AT3 inhibition in human HepG2 cells at 1.0 nM, 0.1 nM and 0.03 nM concentrations in the environment of the HepG2 cells. Each of the six modified duplexes associated with the 16 duplex sequences examined was assessed for AT3 knockdown efficacy (FIGS. 4A to 4D). Duplexes possessing robust AT3 knockdown efficacy at 0.1 nM or even 0.03 nM concentrations were thereby identified, including many possessing knockdown efficacy across most or even the entire range of highly modified forms tested.

In further studies, the following duplex sequences were examined for knockdown efficacy in mouse H36.12J cells across 2'-O-methyl guide strand modification patterns "M48", "M527", "M528" and "M529", paired with "M107" passenger strand modifications: AT3-882, AT3-883, AT3-892, AT3-901, AT3-902, AT3-907, AT3-908, AT3-909, AT3-910, AT3-990, AT3-m1579 and AT3-m1670. Duplexes that showed robust AT3 knockdown efficacy at the tested 0.1 nM concentration in mouse cells across a range of duplex modification patterns were thereby identified (e.g., AT3-882, AT3-883, AT3-892, AT3-901 and AT3-m1579).

Example 5: Assessment of In Vivo Efficacy of AT3-Targeting DsiRNAs

The ability of certain, active AT3-targeting DsiRNAs to reduce AT3 levels within the blood, bone marrow, liver, kidney or other target organ of a mouse is examined. Exemplary DsiRNAs are synthesized with passenger (sense) strand modification pattern "SM107" and guide (antisense) strand modification pattern "M48" (patterns described above). To perform the study, a hemophilia model is obtained. Exemplary animal models of hemophilia are set forth in Lozier and Nichols (*Semin Hematol.* 50(2): 175-184) and include model systems developed from animals possessing spontaneous mutations, such as hemophilia A dogs, rats and sheep, and hemophilia B dogs, as well as engineered hemophilia A and hemophilia B (conditional) knockout mice. Animals are randomized and assigned to groups based on marker levels. Intravenous dosing of animals with lipid nanoparticles (LNPs; optionally, an LNP formulation named EnCore-2345 is employed) containing 1 mg/kg or 0.1 mg/kg of DsiRNA is initiated on day 0. Dosing continues, e.g., BIW for a total of three doses in mice prior to sacrifice and assessment of phenotype and/or knockdown efficacy. Blood, bone marrow, liver and/or kidneys are obtained and AT3 levels are assessed using RT-qPCR, ViewRNA, western blot for AT3 and/or AT3 immunohistochemistry (ViewRNA, western blot for AT3 and AT3 immunohistochemistry). Serum samples are also subjected to ELISA for detection of AT3 (data not shown). DsiRNAs that show robust knockdown of AT3 when administered at 1 mg/kg or other doses are thereby identified.

Example 6: Assessment of Additionally Modified Forms of AT3-Targeting DsiRNAs in Vitro In this example, the same set of 16 AT3-targeting duplex sequences as set forth above in Example 4 are prepared to possess a range of six 2'-O-methyl passenger strand modification patterns ("M107", "M14", "M24", "M250" and two others) coupled with a fixed, e.g., "M48" guide strand modification pattern. These DsiRNAs are assayed for AT3 inhibition at 1.0 nM and 0.1 nM (in duplicate) concentrations in the environment of the HepG2 cells. Human AT3 knockdown efficacy data for each of the four modified duplexes associated with the 16 duplex sequences is examined. Tested duplexes that possess robust AT3 knockdown efficacy, optionally at even 0.1 nM concentrations across the full range of highly modified passenger strand (with fixed guide strand modification pattern) forms tested, are identified.

Optionally, a number of those duplex sequences in mouse which correspond to human duplexes are also examined for knockdown efficacy in mouse H36.12J cells across the same range of four duplex modification patterns (with passenger strand modification patterns varied and guide strand modification pattern fixed, in contrast to the duplexes of Example 4 above). Those duplexes that show robust AT3 knockdown efficacy in mouse cells across a range of duplex modification patterns, optionally at concentrations as low as 0.03 nM, are identified.

TABLE 8

Tetraloop-Configured RNAi Agents

| Name | Sense Sequence (5'→3') | SEQ: | Antisense Seq (5'→3') | SEQ: |
|---|---|---|---|---|
| AT3-142-TL | CCAUGUAUUCCAAUGUGAUAGCAGCCGAAAGGCUGC | 3535 | UAUCACAUUGGAAUACAUGGCC | 3625 |
| AT3-143-TL | CAUGUAUUCCAAUGUGAUAGGCAGCCGAAAGGCUGC | 3536 | CUAUCACAUUGGAAUACAUGGC | 3626 |
| AT3-144-TL | AUGUAUUCCAAUGUGAUAGGGCAGCCGAAAGGCUGC | 3537 | CCUAUCACAUUGGAAUACAUGG | 3627 |
| AT3-145-TL | UGUAUUCCAAUGUGAUAGGAGCAGCCGAAAGGCUGC | 3538 | UCCUAUCACAUUGGAAUACAUG | 3628 |
| AT3-146-TL | GUAUUCCAAUGUGAUAGGAAGCAGCCGAAAGGCUGC | 3539 | UUCCUAUCACAUUGGAAUACAU | 3629 |
| AT3-147-TL | UAUUCCAAUGUGAUAGGAACGCAGCCGAAAGGCUGC | 3540 | GUUCCUAUCACAUUGGAAUACA | 3630 |
| AT3-148-TL | AUUCCAAUGUGAUAGGAACUGCAGCCGAAAGGCUGC | 3541 | AGUUCCUAUCACAUUGGAAUAC | 3631 |
| AT3-173-TL | CUCUGGAAAAAGGAAGGUUUGCAGCCGAAAGGCUGC | 3542 | AAACCUUCCUUUUUCCAGAGGU | 3632 |

TABLE 8-continued

Tetraloop-Configured RNAi Agents

| Name | Sense Sequence (5'→3') | SEQ: | Antisense Seq (5'→3') | SEQ: |
|---|---|---|---|---|
| AT3-174-TL | UCUGGAAAAAGGAAGGUUUAGCAGCCGAAAGGCUGC | 3543 | UAAACCUUCCUUUUUCCAGAGG | 3633 |
| AT3-177-TL | GGAAAAAGGAAGGUUUAUCUGCAGCCGAAAGGCUGC | 3544 | AGAUAAACCUUCCUUUUUCCAG | 3634 |
| AT3-178-TL | GAAAAAGGAAGGUUUAUCUUGCAGCCGAAAGGCUGC | 3545 | AAGAUAAACCUUCCUUUUUCCA | 3635 |
| AT3-179-TL | AAAAAGGAAGGUUUAUCUUUGCAGCCGAAAGGCUGC | 3546 | AAAGAUAAACCUUCCUUUUUCC | 3636 |
| AT3-284-TL | UCCCAUGAAUCCCAUGUGCAGCAGCCGAAAGGCUGC | 3547 | UGCACAUGGGAUUCAUGGGAAU | 3637 |
| AT3-285-TL | CCCAUGAAUCCCAUGUGCAUGCAGCCGAAAGGCUGC | 3548 | AUGCACAUGGGAUUCAUGGGAA | 3638 |
| AT3-288-TL | AUGAAUCCCAUGUGCAUUUAGCAGCCGAAAGGCUGC | 3549 | UAAAUGCACAUGGGAUUCAUGG | 3639 |
| AT3-403-TL | AUUCCCGCUUUGCUACCACUGCAGCCGAAAGGCUGC | 3550 | AGUGGUAGCAAAGCGGGAAUUG | 3640 |
| AT3-406-TL | CCCGCUUUGCUACCACUUUCGCAGCCGAAAGGCUGC | 3551 | GAAAGUGGUAGCAAAGCGGGAA | 3641 |
| AT3-407-TL | CCGCUUUGCUACCACUUUCUGCAGCCGAAAGGCUGC | 3552 | AGAAAGUGGUAGCAAAGCGGGA | 3642 |
| AT3-408-TL | CGCUUUGCUACCACUUUCUAGCAGCCGAAAGGCUGC | 3553 | UAGAAAGUGGUAGCAAAGCGGG | 3643 |
| AT3-409-TL | GCUUUGCUACCACUUUCUAUGCAGCCGAAAGGCUGC | 3554 | AUAGAAAGUGGUAGCAAAGCGG | 3644 |
| AT3-410-TL | CUUUGCUACCACUUUCUAUCGCAGCCGAAAGGCUGC | 3555 | GAUAGAAAGUGGUAGCAAAGCG | 3645 |
| AT3-414-TL | GCUACCACUUUCUAUCAGCAGCAGCCGAAAGGCUGC | 3556 | UGCUGAUAGAAAGUGGUAGCAA | 3646 |
| AT3-504-TL | AUGACCAAGCUGGGUGCCUGGCAGCCGAAAGGCUGC | 3557 | CAGGCACCCAGCUUGGUCAUAG | 3647 |
| AT3-553-TL | UAUUUAAGUUUGACACCAUAGCAGCCGAAAGGCUGC | 3558 | UAUGGUGUCAAACUUAAAUACC | 3648 |
| AT3-558-TL | AAGUUUGACACCAUAUCUGAGCAGCCGAAAGGCUGC | 3559 | UCAGAUAUGGUGUCAAACUUAA | 3649 |
| AT3-559-TL | AGUUUGACACCAUAUCUGAGGCAGCCGAAAGGCUGC | 3560 | CUCAGAUAUGGUGUCAAACUUA | 3650 |
| AT3-565-TL | ACACCAUAUCUGAGAAAACAGCAGCCGAAAGGCUGC | 3561 | UGUUUUCUCAGAUAUGGUGUCA | 3651 |
| AT3-566-TL | CACCAUAUCUGAGAAAACAUGCAGCCGAAAGGCUGC | 3562 | AUGUUUUCUCAGAUAUGGUGUC | 3652 |
| AT3-569-TL | CAUAUCUGAGAAAACAUCUGGCAGCCGAAAGGCUGC | 3563 | CAGAUGUUUUCUCAGAUAUGGU | 3653 |
| AT3-570-TL | AUAUCUGAGAAAACAUCUGAGCAGCCGAAAGGCUGC | 3564 | UCAGAUGUUUUCUCAGAUAUGG | 3654 |
| AT3-571-TL | UAUCUGAGAAAACAUCUGAUGCAGCCGAAAGGCUGC | 3565 | AUCAGAUGUUUUCUCAGAUAUG | 3655 |
| AT3-575-TL | UGAGAAAACAUCUGAUCAGAGCAGCCGAAAGGCUGC | 3566 | UCUGAUCAGAUGUUUUCUCAGA | 3656 |
| AT3-577-TL | AGAAAACAUCUGAUCAGAUCGCAGCCGAAAGGCUGC | 3567 | GAUCUGAUCAGAUGUUUUCUCA | 3657 |
| AT3-589-TL | AUCAGAUCCACUUCUUCUUUGCAGCCGAAAGGCUGC | 3568 | AAAGAAGAAGUGGAUCUGAUCA | 3658 |
| AT3-594-TL | AUCCACUUCUUCUUUGCCAAGCAGCCGAAAGGCUGC | 3569 | UUGGCAAAGAAGAAGUGGAUCU | 3659 |
| AT3-595-TL | UCCACUUCUUCUUUGCCAAAGCAGCCGAAAGGCUGC | 3570 | UUUGGCAAAGAAGAAGUGGAUC | 3660 |
| AT3-600-TL | UUCUUCUUUGCCAAACUGAAGCAGCCGAAAGGCUGC | 3571 | UUCAGUUUGGCAAAGAAGAAGU | 3661 |
| AT3-610-TL | CCAAACUGAACUGCCGACUCGCAGCCGAAAGGCUGC | 3572 | GAGUCGGCAGUUCAGUUUGGCA | 3662 |
| AT3-611-TL | CAAACUGAACUGCCGACUCUGCAGCCGAAAGGCUGC | 3573 | AGAGUCGGCAGUUCAGUUUGGC | 3663 |
| AT3-612-TL | AAACUGAACUGCCGACUCUAGCAGCCGAAAGGCUGC | 3574 | UAGAGUCGGCAGUUCAGUUUGG | 3664 |
| AT3-618-TL | AACUGCCGACUCUAUCGAAAGCAGCCGAAAGGCUGC | 3575 | UUUCGAUAGAGUCGGCAGUUCA | 3665 |
| AT3-619-TL | ACUGCCGACUCUAUCGAAAAGCAGCCGAAAGGCUGC | 3576 | UUUUCGAUAGAGUCGGCAGUUC | 3666 |
| AT3-620-TL | CUGCCGACUCUAUCGAAAAGCAGCAGCCGAAAGGCUGC | 3577 | CUUUUCGAUAGAGUCGGCAGUU | 3667 |
| AT3-624-TL | CGACUCUAUCGAAAAGCCAAGCAGCCGAAAGGCUGC | 3578 | UUGGCUUUUCGAUAGAGUCGGC | 3668 |
| AT3-628-TL | UCUAUCGAAAAGCCAACAAAGCAGCCGAAAGGCUGC | 3579 | UUUGUUGGCUUUUCGAUAGAGU | 3669 |
| AT3-635-TL | AAAAGCCAACAAAUCCUCCAGCAGCCGAAAGGCUGC | 3580 | UGGAGGAUUUGUUGGCUUUUCG | 3670 |

TABLE 8-continued

Tetraloop-Configured RNAi Agents

| Name | Sense Sequence (5'→3') | SEQ: | Antisense Seq (5'→3') | SEQ: |
|---|---|---|---|---|
| AT3-640-TL | CCAACAAAUCCUCCAAGUUAGCAGCCGAAAGGCUGC | 3581 | UAACUUGGAGGAUUUGUUGGCU | 3671 |
| AT3-670-TL | AUCGCCUUUUUGGAGACAAAGCAGCCGAAAGGCUGC | 3582 | UUUGUCUCCAAAAAGGCGAUUG | 3672 |
| AT3-689-TL | AUCCCUUACCUUCAAUGAGAGCAGCCGAAAGGCUGC | 3583 | UCUCAUUGAAGGUAAGGGAUUU | 3673 |
| AT3-882-TL | CUGGUUAACACCAUUUACUUGCAGCCGAAAGGCUGC | 3584 | AAGUAAAUGGUGUUAACCAGCA | 3674 |
| AT3-883-TL | UGGUUAACACCAUUUACUUCGCAGCCGAAAGGCUGC | 3585 | GAAGUAAAUGGUGUUAACCAGC | 3675 |
| AT3-892-TL | CCAUUUACUUCAAGGGCCUGGCAGCCGAAAGGCUGC | 3586 | CAGGCCCUUGAAGUAAAUGGUG | 3676 |
| AT3-901-TL | UCAAGGGCCUGUGGAAGUCAGCAGCCGAAAGGCUGC | 3587 | UGACUUCCACAGGCCCUUGAAG | 3677 |
| AT3-902-TL | CAAGGGCCUGUGGAAGUCAAGCAGCCGAAAGGCUGC | 3588 | UUGACUUCCACAGGCCCUUGAA | 3678 |
| AT3-907-TL | GCCUGUGGAAGUCAAAGUUCGCAGCCGAAAGGCUGC | 3589 | GAACUUUGACUUCCACAGGCCC | 3679 |
| AT3-908-TL | CCUGUGGAAGUCAAAGUUCAGCAGCCGAAAGGCUGC | 3590 | UGAACUUUGACUUCCACAGGCC | 3680 |
| AT3-909-TL | CUGUGGAAGUCAAAGUUCAGGCAGCCGAAAGGCUGC | 3591 | CUGAACUUUGACUUCCACAGGC | 3681 |
| AT3-910-TL | UGUGGAAGUCAAAGUUCAGCGCAGCCGAAAGGCUGC | 3592 | GCUGAACUUUGACUUCCACAGG | 3682 |
| AT3-966-TL | GAUGGAGAGUCGUGUUCAGCGCAGCCGAAAGGCUGC | 3593 | GCUGAACACGACUCUCCAUCAG | 3683 |
| AT3-967-TL | AUGGAGAGUCGUGUUCAGCAGCAGCCGAAAGGCUGC | 3594 | UGCUGAACACGACUCUCCAUCA | 3684 |
| AT3-990-TL | AUGAUGUACCAGGAAGGCAAGCAGCCGAAAGGCUGC | 3595 | UUGCCUUCCUGGUACAUCAUAG | 3685 |
| AT3-1227-TL | AGUUUGAAGGAGCAGCUGCAGCAGCCGAAAGGCUGC | 3596 | UGCAGCUGCUCCUUCAAACUGA | 3686 |
| AT3-1233-TL | AAGGAGCAGCUGCAAGACAUGCAGCCGAAAGGCUGC | 3597 | AUGUCUUGCAGCUGCUCCUUCA | 3687 |
| AT3-1234-TL | AGGAGCAGCUGCAAGACAUGGCAGCCGAAAGGCUGC | 3598 | CAUGUCUUGCAGCUGCUCCUUC | 3688 |
| AT3-1239-TL | CAGCUGCAAGACAUGGGCCUGCAGCCGAAAGGCUGC | 3599 | AGGCCCAUGUCUUGCAGCUGCU | 3689 |
| AT3-1281-TL | AAGUCCAAACUCCCAGGUAUGCAGCCGAAAGGCUGC | 3600 | AUACCUGGGAGUUUGGACUUUU | 3690 |
| AT3-1285-TL | CCAAACUCCCAGGUAUUGUUGCAGCCGAAAGGCUGC | 3601 | AACAAUACCUGGGAGUUUGGAC | 3691 |
| AT3-1344-TL | CAUAAGGCAUUUCUUGAGGUGCAGCCGAAAGGCUGC | 3602 | ACCUCAAGAAAUGCCUUAUGGA | 3692 |
| AT3-1345-TL | AUAAGGCAUUUCUUGAGGUAGCAGCCGAAAGGCUGC | 3603 | UACCUCAAGAAAUGCCUUAUGG | 3693 |
| AT3-1346-TL | UAAGGCAUUUCUUGAGGUAAGCAGCCGAAAGGCUGC | 3604 | UUACCUCAAGAAAUGCCUUAUG | 3694 |
| AT3-1347-TL | AAGGCAUUUCUUGAGGUAAAGCAGCCGAAAGGCUGC | 3605 | UUUACCUCAAGAAAUGCCUUAU | 3695 |
| AT3-1351-TL | CAUUUCUUGAGGUAAAUGAAGCAGCCGAAAGGCUGC | 3606 | UUCAUUUACCUCAAGAAAUGCC | 3696 |
| AT3-1369-TL | AAGAAGGCAGUGAAGCAGCUGCAGCCGAAAGGCUGC | 3607 | AGCUGCUUCACUGCCUUCUUCA | 3697 |
| AT3-1459-TL | CUUUCCUGGUUUUUAUAAGAGCAGCCGAAAGGCUGC | 3608 | UCUUAUAAAAACCAGGAAAGGC | 3698 |
| AT3-1461-TL | UUCCUGGUUUUUAUAAGAGAGCAGCCGAAAGGCUGC | 3609 | UCUCUUAUAAAAACCAGGAAAG | 3699 |
| AT3-1465-TL | UGGUUUUUAUAAGAGAAGUUGCAGCCGAAAGGCUGC | 3610 | AACUUCUCUUAUAAAAACCAGG | 3700 |
| AT3-1473-TL | AUAAGAGAAGUUCCUCUGAAGCAGCCGAAAGGCUGC | 3611 | UUCAGAGGAACUUCUCUUAUAA | 3701 |

TABLE 8-continued

Tetraloop-Configured RNAi Agents

| Name | Sense Sequence (5'→3') | SEQ: | Antisense Seq (5'→3') | SEQ: |
|---|---|---|---|---|
| AT3-1475-TL | AAGAGAAGUUCCUCUGAACAGCAGCCGAAAGGCUGC | 3612 | UGUUCAGAGGAACUUCUCUUAU | 3702 |
| AT3-1476-TL | AGAGAAGUUCCUCUGAACACGCAGCCGAAAGGCUGC | 3613 | GUGUUCAGAGGAACUUCUCUUA | 3703 |
| AT3-1478-TL | AGAAGUUCCUCUGAACACUAGCAGCCGAAAGGCUGC | 3614 | UAGUGUUCAGAGGAACUUCUCU | 3704 |
| AT3-1479-TL | GAAGUUCCUCUGAACACUAUGCAGCCGAAAGGCUGC | 3615 | AUAGUGUUCAGAGGAACUUCUC | 3705 |
| AT3-1480-TL | AAGUUCCUCUGAACACUAUUGCAGCCGAAAGGCUGC | 3616 | AAUAGUGUUCAGAGGAACUUCU | 3706 |
| AT3-1481-TL | AGUUCCUCUGAACACUAUUAGCAGCCGAAAGGCUGC | 3617 | UAAUAGUGUUCAGAGGAACUUC | 3707 |
| AT3-1483-TL | UUCCUCUGAACACUAUUAUCGCAGCCGAAAGGCUGC | 3618 | GAUAAUAGUGUUCAGAGGAACU | 3708 |
| AT3-1485-TL | CCUCUGAACACUAUUAUCUUGCAGCCGAAAGGCUGC | 3619 | AAGAUAAUAGUGUUCAGAGGAA | 3709 |
| AT3-1486-TL | CUCUGAACACUAUUAUCUUCGCAGCCGAAAGGCUGC | 3620 | GAAGAUAAUAGUGUUCAGAGGA | 3710 |
| AT3-1488-TL | CUGAACACUAUUAUCUUCAUGCAGCCGAAAGGCUGC | 3621 | AUGAAGAUAAUAGUGUUCAGAG | 3711 |
| AT3-1493-TL | CACUAUUAUCUUCAUGGGCAGCAGCCGAAAGGCUGC | 3622 | UGCCCAUGAAGAUAAUAGUGUU | 3712 |
| AT3-1584-TL | AGAAGUAAAAAUAAAUACAAGCAGCCGAAAGGCUGC | 3623 | UUGUAUUUAUUUUUACUUCUGU | 3713 |
| AT3-1585-TL | GAAGUAAAAAUAAAUACAAAGCAGCCGAAAGGCUGC | 3624 | UUUGUAUUUAUUUUUACUUCUG | 3714 |

22 nucleotide AT3 mRNA target sequences for each of the above tetraloop-configured agents are shown in Table 9 below.

TABLE 9

Tetraloop-Configured RNAi AgentAT3 mRNA 22 nt Target Sequences

| Name | 22 nt AT3 mRNA Target (5' → 3') | SEQ: |
|---|---|---|
| AT3-142-TL | GGCCAUGUAUUCCAAUGUGAUA | 3715 |
| AT3-143-TL | GCCAUGUAUUCCAAUGUGAUAG | 3716 |
| AT3-144-TL | CCAUGUAUUCCAAUGUGAUAGG | 3717 |
| AT3-145-TL | CAUGUAUUCCAAUGUGAUAGGA | 3718 |
| AT3-146-TL | AUGUAUUCCAAUGUGAUAGGAA | 3719 |
| AT3-147-TL | UGUAUUCCAAUGUGAUAGGAAC | 3720 |
| AT3-148-TL | GUAUUCCAAUGUGAUAGGAACU | 3721 |
| AT3-173-TL | ACCUCUGGAAAAGGAAGGUUU | 3722 |
| AT3-174-TL | CCUCUGGAAAAGGAAGGUUUA | 3723 |
| AT3-177-TL | CUGGAAAAGGAAGGUUUAUCU | 3724 |
| AT3-178-TL | UGGAAAAGGAAGGUUUAUCUU | 3725 |
| AT3-179-TL | GGAAAAGGAAGGUUUAUCUUU | 3726 |
| AT3-284-TL | AUUCCCAUGAAUCCCAUGUGCA | 3727 |
| AT3-285-TL | UUCCCAUGAAUCCCAUGUGCAU | 3728 |
| AT3-288-TL | CCAUGAAUCCCAUGUGCAUUUA | 3729 |
| AT3-403-TL | CAAUUCCCGCUUUGCUACCACU | 3730 |
| AT3-406-TL | UUCCCGCUUUGCUACCACUUUC | 3731 |
| AT3-407-TL | UCCCGCUUUGCUACCACUUUCU | 3732 |
| AT3-408-TL | CCCGCUUUGCUACCACUUUCUA | 3733 |
| AT3-409-TL | CCGCUUUGCUACCACUUUCUAU | 3734 |
| AT3-410-TL | CGCUUUGCUACCACUUUCUAUC | 3735 |
| AT3-414-TL | UUGCUACCACUUUCUAUCAGCA | 3736 |

TABLE 9-continued

Tetraloop-Configured RNAi AgentAT3 mRNA 22 nt Target Sequences

| Name | 22 nt AT3 mRNA Target (5' → 3') | SEQ: |
|---|---|---|
| AT3-504-TL | CUAUGACCAAGCUGGGUGCCUG | 3737 |
| AT3-553-TL | GGUAUUUAAGUUUGACACCAUA | 3738 |
| AT3-558-TL | UUAAGUUUGACACCAUAUCUGA | 3739 |
| AT3-559-TL | UAAGUUUGACACCAUAUCUGAG | 3740 |
| AT3-565-TL | UGACACCAUAUCUGAGAAAACA | 3741 |
| AT3-566-TL | GACACCAUAUCUGAGAAAACAU | 3742 |
| AT3-569-TL | ACCAUAUCUGAGAAAACAUCUG | 3743 |
| AT3-570-TL | CCAUAUCUGAGAAAACAUCUGA | 3744 |
| AT3-571-TL | CAUAUCUGAGAAAACAUCUGAU | 3745 |
| AT3-575-TL | UCUGAGAAAACAUCUGAUCAGA | 3746 |
| AT3-577-TL | UGAGAAAACAUCUGAUCAGAUC | 3747 |
| AT3-589-TL | UGAUCAGAUCCACUUCUUCUUU | 3748 |
| AT3-594-TL | AGAUCCACUUCUUCUUUGCCAA | 3749 |
| AT3-595-TL | GAUCCACUUCUUCUUUGCCAAA | 3750 |
| AT3-600-TL | ACUUCUUCUUUGCCAAACUGAA | 3751 |
| AT3-610-TL | UGCCAAACUGAACUGCCGACUC | 3752 |
| AT3-611-TL | GCCAAACUGAACUGCCGACUCU | 3753 |
| AT3-612-TL | CCAAACUGAACUGCCGACUCUA | 3754 |
| AT3-618-TL | UGAACUGCCGACUCUAUCGAAA | 3755 |
| AT3-619-TL | GAACUGCCGACUCUAUCGAAAA | 3756 |
| AT3-620-TL | AACUGCCGACUCUAUCGAAAAG | 3757 |
| AT3-624-TL | GCCGACUCUAUCGAAAAGCCAA | 3758 |
| AT3-628-TL | ACUCUAUCGAAAAGCCAACAAA | 3759 |
| AT3-635-TL | CGAAAAGCCAACAAAUCCUCCA | 3760 |
| AT3-640-TL | AGCCAACAAAUCCUCCAAGUUA | 3761 |
| AT3-670-TL | CAAUCGCCUUUUGGAGACAAA | 3762 |
| AT3-689-TL | AAAUCCCUUACCUUCAAUGAGA | 3763 |
| AT3-882-TL | UGCUGGUUAACACCAUUUACUU | 3764 |
| AT3-883-TL | GCUGGUUAACACCAUUUACUUC | 3765 |
| AT3-892-TL | CACCAUUUACUUCAAGGGCCUG | 3766 |
| AT3-901-TL | CUUCAAGGGCCUGUGGAAGUCA | 3767 |
| AT3-902-TL | UUCAAGGGCCUGUGGAAGUCAA | 3768 |
| AT3-907-TL | GGGCCUGUGGAAGUCAAAGUUC | 3769 |
| AT3-908-TL | GGCCUGUGGAAGUCAAAGUUCA | 3770 |
| AT3-909-TL | GCCUGUGGAAGUCAAAGUUCAG | 3771 |
| AT3-910-TL | CCUGUGGAAGUCAAAGUUCAGC | 3772 |
| AT3-966-TL | CUGAUGGAGAGUCGUGUUCAGC | 3773 |
| AT3-967-TL | UGAUGGAGAGUCGUGUUCAGCA | 3774 |
| AT3-990-TL | CUAUGAUGUACCAGGAAGGCAA | 3775 |
| AT3-1227-TL | UCAGUUUGAAGGAGCAGCUGCA | 3776 |
| AT3-1233-TL | UGAAGGAGCAGCUGCAAGACAU | 3777 |
| AT3-1234-TL | GAAGGAGCAGCUGCAAGACAUG | 3778 |
| AT3-1239-TL | AGCAGCUGCAAGACAUGGGCCU | 3779 |
| AT3-1281-TL | AAAAGUCCAAACUCCCAGGUAU | 3780 |
| AT3-1285-TL | GUCCAAACUCCCAGGUAUUGUU | 3781 |
| AT3-1344-TL | UCCAUAAGGCAUUUCUUGAGGU | 3782 |
| AT3-1345-TL | CCAUAAGGCAUUUCUUGAGGUA | 3783 |
| AT3-1346-TL | CAUAAGGCAUUUCUUGAGGUAA | 3784 |
| AT3-1347-TL | AUAAGGCAUUUCUUGAGGUAAA | 3785 |
| AT3-1351-TL | GGCAUUUCUUGAGGUAAAUGAA | 3786 |
| AT3-1369-TL | UGAAGAAGGCAGUGAAGCAGCU | 3787 |
| AT3-1459-TL | GCCUUUCCUGGUUUUUAUAAGA | 3788 |
| AT3-1461-TL | CUUUCCUGGUUUUUAUAAGAGA | 3789 |
| AT3-1465-TL | CCUGGUUUUUAUAAGAGAAGUU | 3790 |
| AT3-1473-TL | UUAUAAGAGAAGUUCCUCUGAA | 3791 |
| AT3-1475-TL | AUAAGAGAAGUUCCUCUGAACA | 3792 |
| AT3-1476-TL | UAAGAGAAGUUCCUCUGAACAC | 3793 |
| AT3-1478-TL | AGAGAAGUUCCUCUGAACACUA | 3794 |
| AT3-1479-TL | GAGAAGUUCCUCUGAACACUAU | 3795 |
| AT3-1480-TL | AGAAGUUCCUCUGAACACUAUU | 3796 |
| AT3-1481-TL | GAAGUUCCUCUGAACACUAUUA | 3797 |
| AT3-1483-TL | AGUUCCUCUGAACACUAUUAUC | 3798 |
| AT3-1485-TL | UUCCUCUGAACACUAUUAUCUU | 3799 |
| AT3-1486-TL | UCCUCUGAACACUAUUAUCUUC | 3800 |
| AT3-1488-TL | CUCUGAACACUAUUAUCUUCAU | 3801 |
| AT3-1493-TL | AACACUAUUAUCUUCAUGGGCA | 3802 |
| AT3-1584-TL | ACAGAAGUAAAAUAAAUACAA | 3803 |
| AT3-1585-TL | CAGAAGUAAAAUAAAUACAAA | 3804 |

The following tetraloop-configured agents were synthesized with the structures as shown in Table 8: AT3-143-TL, AT3-145-TL, AT3-177-TL, AT3-179-TL, AT3-595-TL, AT3-600-TL, AT3-882-TL, AT3-883-TL, AT3-990-TL and AT3-1585-TL. Robust AT3 inhibitory activity was identified for these tetraloop-reconfigured agents in vitro and in vivo.

Example 8: Indications

The present body of knowledge in AT3 research indicates the need for methods to assay AT3 activity and for compounds that can regulate AT3 expression for research, diagnostic, and therapeutic use. As described herein, the nucleic acid molecules of the present invention can be used in assays to diagnose disease state related to AT3 levels. In addition, the nucleic acid molecules can be used to treat disease state related to AT3 functionality, misregulation, levels, etc.

Particular disorders and disease states that can be associated with AT3 expression modulation include, but are not limited to hemophilia, including phenotypes of such disease in organs such as blood, bone marrow, liver, kidney, eye, skin, etc.

Other therapeutic agents (e.g., Concizumab, as discussed above) can be combined with or used in conjunction with the nucleic acid molecules (e.g. DsiRNA molecules) of the instant invention. Those skilled in the art will recognize that other compounds and therapies used to treat the diseases and conditions described herein can be combined with the nucleic acid molecules of the instant invention (e.g. siNA molecules, e.g., such as those directed to other enzymes in the targeted complement cascade) and are hence within the scope of the instant invention. For example, for combination therapy, the nucleic acids of the invention can be prepared in one of at least two ways. First, the agents are physically combined in a preparation of nucleic acid and other agent, such as a mixture of a nucleic acid of the invention encapsulated in liposomes and other agent in a solution for intravenous administration, wherein both agents are present in a therapeutically effective concentration (e.g., the other agent in solution to deliver 1000-1250 mg/m2/day and liposome-associated nucleic acid of the invention in the same solution to deliver 0.1-100 mg/kg/day). Alternatively, the agents are administered separately but simultaneously or successively in their respective effective doses (e.g., 1000-1250 mg/m2/d other agent and 0.1 to 100 mg/kg/day nucleic acid of the invention).

Example 9: Serum Stability for DsiRNAs

Serum stability of DsiRNA agents is assessed via incubation of DsiRNA agents in 50% fetal bovine serum for various periods of time (up to 24 h) at 37° C. Serum is extracted and the nucleic acids are separated on a 20% non-denaturing PAGE and can be visualized with Gelstar stain. Relative levels of protection from nuclease degradation are assessed for DsiRNAs (optionally with and without modifications).

Example 10: Diagnostic Uses

The DsiRNA molecules of the invention can be used in a variety of diagnostic applications, such as in the identification of molecular targets (e.g., RNA) in a variety of applications, for example, in clinical, industrial, environmental, agricultural and/or research settings. Such diagnostic use of DsiRNA molecules involves utilizing reconstituted RNAi systems, for example, using cellular lysates or partially purified cellular lysates. DsiRNA molecules of this invention can be used as diagnostic tools to examine genetic drift and mutations within diseased cells. The close relationship between DsiRNA activity and the structure of the target AT3 RNA allows the detection of mutations in a region of the AT3 molecule, which alters the base-pairing and three-dimensional structure of the target AT3 RNA. By using multiple DsiRNA molecules described in this invention, one can map nucleotide changes, which are important to RNA structure and function in vitro, as well as in cells and tissues. Cleavage of target AT3 RNAs with DsiRNA molecules can be used to inhibit gene expression and define the role of specified gene products in the progression of an AT3-associated disease or disorder. In this manner, other genetic targets can be defined as important mediators of the disease. These experiments will lead to better treatment of the disease progression by affording the possibility of combination therapies (e.g., multiple DsiRNA molecules targeted to different genes, DsiRNA molecules coupled with known peptide/antibody and/or small molecule inhibitors, or intermittent treatment with combinations of DsiRNA molecules and/or other chemical or biological molecules). Other in vitro uses of DsiRNA molecules of this invention are well known in the art, and include detection of the presence of RNAs associated with a disease or related condition. Such RNA is detected by determining the presence of a cleavage product after treatment with a DsiRNA using standard methodologies, for example, fluorescence resonance emission transfer (FRET).

All patents and publications mentioned in the specification are indicative of the levels of skill of those skilled in the art to which the invention pertains. All references cited in this disclosure are incorporated by reference to the same extent as if each reference had been incorporated by reference in its entirety individually.

One skilled in the art would readily appreciate that the present invention is well adapted to carry out the objects and obtain the ends and advantages mentioned, as well as those inherent therein. The methods and compositions described herein as presently representative of preferred embodiments are exemplary and are not intended as limitations on the scope of the invention. Changes therein and other uses will occur to those skilled in the art, which are encompassed within the spirit of the invention, are defined by the scope of the claims.

It will be readily apparent to one skilled in the art that varying substitutions and modifications can be made to the invention disclosed herein without departing from the scope and spirit of the invention. Thus, such additional embodiments are within the scope of the present invention and the following claims. The present invention teaches one skilled in the art to test various combinations and/or substitutions of chemical modifications described herein toward generating nucleic acid constructs with improved activity for mediating RNAi activity. Such improved activity can comprise improved stability, improved bioavailability, and/or improved activation of cellular responses mediating RNAi. Therefore, the specific embodiments described herein are not limiting and one skilled in the art can readily appreciate that specific combinations of the modifications described herein can be tested without undue experimentation toward identifying DsiRNA molecules with improved RNAi activity.

The invention illustratively described herein suitably can be practiced in the absence of any element or elements, limitation or limitations that are not specifically disclosed herein. Thus, for example, in each instance herein any of the terms "comprising", "consisting essentially of", and "consisting of" may be replaced with either of the other two terms. The terms and expressions which have been employed are used as terms of description and not of limitation, and there is no intention that in the use of such terms and expressions of excluding any equivalents of the features shown and described or portions thereof, but it is recognized that various modifications are possible within the scope of the invention claimed. Thus, it should be understood that although the present invention has been specifically disclosed by preferred embodiments, optional features, modification and variation of the concepts herein disclosed may be resorted to by those skilled in the art, and that such modifications and variations are considered to be within the scope of this invention as defined by the description and the appended claims.

In addition, where features or aspects of the invention are described in terms of Markush groups or other grouping of alternatives, those skilled in the art will recognize that the invention is also thereby described in terms of any individual member or subgroup of members of the Markush group or other group.

The use of the terms "a" and "an" and "the" and similar referents in the context of describing the invention (especially in the context of the following claims) are to be construed to cover both the singular and the plural, unless otherwise indicated herein or clearly contradicted by context. The terms "comprising," "having," "including," and "containing" are to be construed as open-ended terms (i.e., meaning "including, but not limited to,") unless otherwise noted. Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

Embodiments of this invention are described herein, including the best mode known to the inventors for carrying out the invention. Variations of those embodiments may become apparent to those of ordinary skill in the art upon reading the foregoing description.

The inventors expect skilled artisans to employ such variations as appropriate, and the inventors intend for the invention to be practiced otherwise than as specifically described herein. Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context. Those skilled in the art will recognize, or be able to ascertain using no more than routine experimentation, many equivalents to the specific embodiments of the invention described herein. Such equivalents are intended to be encompassed by the following claims.

SEQUENCE LISTING (3804 sequences)

SEQ ID NO: 1 - DNA, 25 bp, Artificial Sequence
  Synthetic oligonucleotide
ccauguauuccaaugugauaggaac

SEQ ID NO: 2 - DNA, 25 bp, Artificial Sequence
  Synthetic oligonucleotide
cauguauuccaaugugauaggaact

SEQ ID NO: 3 - DNA, 25 bp, Artificial Sequence
  Synthetic oligonucleotide
auguauuccaaugugauaggaactg

SEQ ID NO: 4 - DNA, 25 bp, Artificial Sequence
  Synthetic oligonucleotide
uguauuccaaugugauaggaacugt

SEQ ID NO: 5 - DNA, 25 bp, Artificial Sequence
  Synthetic oligonucleotide
guauuccaaugugauaggaacugta

SEQ ID NO: 6 - DNA, 25 bp, Artificial Sequence
  Synthetic oligonucleotide
uauuccaaugugauaggaacuguaa

SEQ ID NO: 7 - DNA, 25 bp, Artificial Sequence
  Synthetic oligonucleotide
auuccaaugugauaggaacuguaac

SEQ ID NO: 8 - DNA, 25 bp, Artificial Sequence
  Synthetic oligonucleotide
cucuggaaaaaggaagguuuauctt

SEQ ID NO: 9 - DNA, 25 bp, Artificial Sequence
  Synthetic oligonucleotide
ucuggaaaaaggaagguuuaucutt

SEQ ID NO: 10 - DNA, 25 bp, Artificial Sequence
  Synthetic oligonucleotide
cuggaaaaaggaagguuuaucuutt

SEQ ID NO: 11 - DNA, 25 bp, Artificial Sequence
  Synthetic oligonucleotide
ggaaaaaggaagguuuaucuuuugt

SEQ ID NO: 12 - DNA, 25 bp, Artificial Sequence
  Synthetic oligonucleotide
gaaaaaggaagguuuaucuuuugtc

SEQ ID NO: 13 - DNA, 25 bp, Artificial Sequence
  Synthetic oligonucleotide
aaaaaggaagguuuaucuuuugucc

SEQ ID NO: 14 - DNA, 25 bp, Artificial Sequence
  Synthetic oligonucleotide
ucccaugaaucccaugugcauuuac

SEQ ID NO: 15 - DNA, 25 bp, Artificial Sequence
  Synthetic oligonucleotide
cccaugaaucccaugugcauuuacc

SEQ ID NO: 16 - DNA, 25 bp, Artificial Sequence
  Synthetic oligonucleotide
augaaucccaugugcauuuaccgct

SEQ ID NO: 17 - DNA, 25 bp, Artificial Sequence
  Synthetic oligonucleotide
ugugcauuuaccgcuccccggagaa

SEQ ID NO: 18 - DNA, 25 bp, Artificial Sequence
  Synthetic oligonucleotide
gucugggaacuguccaaggccaatt

SEQ ID NO: 19 - DNA, 25 bp, Artificial Sequence
  Synthetic oligonucleotide
ucugggaacuguccaaggccaautc

SEQ ID NO: 20 - DNA, 25 bp, Artificial Sequence
  Synthetic oligonucleotide
cugggaacuguccaaggccaauucc

SEQ ID NO: 21 - DNA, 25 bp, Artificial Sequence
  Synthetic oligonucleotide
ugggaacuguccaaggccaauuccc

SEQ ID NO: 22 - DNA, 25 bp, Artificial Sequence
  Synthetic oligonucleotide
gggaacuguccaaggccaauucccg

SEQ ID NO: 23 - DNA, 25 bp, Artificial Sequence
  Synthetic oligonucleotide
ggaacuguccaaggccaauucccgc

SEQ ID NO: 24 - DNA, 25 bp, Artificial Sequence
  Synthetic oligonucleotide
gaacuguccaaggccaauucccgct

SEQ ID NO: 25 - DNA, 25 bp, Artificial Sequence
  Synthetic oligonucleotide
aacuguccaaggccaauucccgctt

SEQ ID NO: 26 - DNA, 25 bp, Artificial Sequence
  Synthetic oligonucleotide
auucccgcuuugcuaccacuuucta

SEQ ID NO: 27 - DNA, 25 bp, Artificial Sequence
  Synthetic oligonucleotide
cccgcuuugcuaccacuuucuauca

SEQ ID NO: 28 - DNA, 25 bp, Artificial Sequence
  Synthetic oligonucleotide
ccgcuuugcuaccacuuucuaucag

SEQ ID NO: 29 - DNA, 25 bp, Artificial Sequence
  Synthetic oligonucleotide
cgcuuugcuaccacuuucuaucagc

SEQ ID NO: 30 - DNA, 25 bp, Artificial Sequence
  Synthetic oligonucleotide
gcuuugcuaccacuuucuaucagca

SEQ ID NO: 31 - DNA, 25 bp, Artificial Sequence
  Synthetic oligonucleotide
cuuugcuaccacuuucuaucagcac

SEQ ID NO: 32 - DNA, 25 bp, Artificial Sequence
  Synthetic oligonucleotide
uuugcuaccacuuucuaucagcacc

SEQ ID NO: 33 - DNA, 25 bp, Artificial Sequence
  Synthetic oligonucleotide
uugcuaccacuuucuaucagcacct

SEQ ID NO: 34 - DNA, 25 bp, Artificial Sequence
  Synthetic oligonucleotide
ugcuaccacuuucuaucagcacctg

SEQ ID NO: 35 - DNA, 25 bp, Artificial Sequence
  Synthetic oligonucleotide
gcuaccacuuucuaucagcaccugg

SEQ ID NO: 36 - DNA, 25 bp, Artificial Sequence
  Synthetic oligonucleotide
accuggcagauuccaagaaugacaa

SEQ ID NO: 37 - DNA, 25 bp, Artificial Sequence
  Synthetic oligonucleotide
gauaacauuuuccugucaccccuga

SEQ ID NO: 38 - DNA, 25 bp, Artificial Sequence
  Synthetic oligonucleotide
aacauuuuccugucaccccugagta

SEQ ID NO: 39 - DNA, 25 bp, Artificial Sequence
  Synthetic oligonucleotide
cauuuuccugucaccccugaguatc

SEQ ID NO: 40 - DNA, 25 bp, Artificial Sequence
  Synthetic oligonucleotide
gcuuuugcuaugaccaagcugggtg

SEQ ID NO: 41 - DNA, 25 bp, Artificial Sequence
  Synthetic oligonucleotide
cuuuugcuaugaccaagcugggugc

SEQ ID NO: 42 - DNA, 25 bp, Artificial Sequence
  Synthetic oligonucleotide
uuuugcuaugaccaagcugggugcc

SEQ ID NO: 43 - DNA, 25 bp, Artificial Sequence
  Synthetic oligonucleotide
uuugcuaugaccaagcugggugcct

SEQ ID NO: 44 - DNA, 25 bp, Artificial Sequence
  Synthetic oligonucleotide
uugcuaugaccaagcugggugcctg

SEQ ID NO: 45 - DNA, 25 bp, Artificial Sequence
  Synthetic oligonucleotide
ugcuaugaccaagcugggugccugt

SEQ ID NO: 46 - DNA, 25 bp, Artificial Sequence
  Synthetic oligonucleotide
gcuaugaccaagcugggugccugta

SEQ ID NO: 47 - DNA, 25 bp, Artificial Sequence
  Synthetic oligonucleotide
cuaugaccaagcugggugccuguaa

SEQ ID NO: 48 - DNA, 25 bp, Artificial Sequence
  Synthetic oligonucleotide
uaugaccaagcugggugccuguaat

SEQ ID NO: 49 - DNA, 25 bp, Artificial Sequence
  Synthetic oligonucleotide
augaccaagcugggugccuguaatg

SEQ ID NO: 50 - DNA, 25 bp, Artificial Sequence
  Synthetic oligonucleotide
ugaccaagcugggugccuguaauga

SEQ ID NO: 51 - DNA, 25 bp, Artificial Sequence
  Synthetic oligonucleotide
gaccaagcugggugccuguaaugac

SEQ ID NO: 52 - DNA, 25 bp, Artificial Sequence
  Synthetic oligonucleotide
accaagcugggugccuguaaugaca

SEQ ID NO: 53 - DNA, 25 bp, Artificial Sequence
  Synthetic oligonucleotide
ccaagcugggugccuguaaugacac

SEQ ID NO: 54 - DNA, 25 bp, Artificial Sequence
  Synthetic oligonucleotide
agcaacugauggagguauuuaagtt

SEQ ID NO: 55 - DNA, 25 bp, Artificial Sequence
  Synthetic oligonucleotide
gcaacugauggagguauuuaagutt

SEQ ID NO: 56 - DNA, 25 bp, Artificial Sequence
  Synthetic oligonucleotide
caacugauggagguauuuaaguutg

SEQ ID NO: 57 - DNA, 25 bp, Artificial Sequence
  Synthetic oligonucleotide
aacugauggagguauuuaaguuuga

SEQ ID NO: 58 - DNA, 25 bp, Artificial Sequence
  Synthetic oligonucleotide
acugauggagguauuuaaguuugac

SEQ ID NO: 59 - DNA, 25 bp, Artificial Sequence
  Synthetic oligonucleotide
cugauggagguauuuaaguuugaca

SEQ ID NO: 60 - DNA, 25 bp, Artificial Sequence
  Synthetic oligonucleotide
ugauggagguauuuaaguuugacac

SEQ ID NO: 61 - DNA, 25 bp, Artificial Sequence
  Synthetic oligonucleotide
gauggagguauuuaaguuugacacc

SEQ ID NO: 62 - DNA, 25 bp, Artificial Sequence
  Synthetic oligonucleotide
auggagguauuuaaguuugacacca

SEQ ID NO: 63 - DNA, 25 bp, Artificial Sequence
  Synthetic oligonucleotide
uggagguauuuaaguuugacaccat

SEQ ID NO: 64 - DNA, 25 bp, Artificial Sequence
  Synthetic oligonucleotide
ggagguauuuaaguuugacaccata

SEQ ID NO: 65 - DNA, 25 bp, Artificial Sequence
  Synthetic oligonucleotide
gagguauuuaaguuugacaccauat

SEQ ID NO: 66 - DNA, 25 bp, Artificial Sequence
  Synthetic oligonucleotide
agguauuuaaguuugacaccauatc

SEQ ID NO: 67 - DNA, 25 bp, Artificial Sequence
  Synthetic oligonucleotide
gguauuuaaguuugacaccauauct

SEQ ID NO: 68 - DNA, 25 bp, Artificial Sequence
  Synthetic oligonucleotide
guauuuaaguuugacaccauauctg

SEQ ID NO: 69 - DNA, 25 bp, Artificial Sequence
  Synthetic oligonucleotide
uauuuaaguuugacaccauaucuga

SEQ ID NO: 70 - DNA, 25 bp, Artificial Sequence
  Synthetic oligonucleotide
auuuaaguuugacaccauaucugag

SEQ ID NO: 71 - DNA, 25 bp, Artificial Sequence
  Synthetic oligonucleotide
uuuaaguuugacaccauaucugaga

SEQ ID NO: 72 - DNA, 25 bp, Artificial Sequence
  Synthetic oligonucleotide
uuaaguuugacaccauaucugagaa

SEQ ID NO: 73 - DNA, 25 bp, Artificial Sequence
  Synthetic oligonucleotide
uaaguuugacaccauaucugagaaa

SEQ ID NO: 74 - DNA, 25 bp, Artificial Sequence
  Synthetic oligonucleotide
aaguuugacaccauaucugagaaaa

SEQ ID NO: 75 - DNA, 25 bp, Artificial Sequence
  Synthetic oligonucleotide
aguuugacaccauaucugagaaaac

SEQ ID NO: 76 - DNA, 25 bp, Artificial Sequence
  Synthetic oligonucleotide
guuugacaccauaucugagaaaaca

SEQ ID NO: 77 - DNA, 25 bp, Artificial Sequence
  Synthetic oligonucleotide
uuugacaccauaucugagaaaacat

SEQ ID NO: 78 - DNA, 25 bp, Artificial Sequence
  Synthetic oligonucleotide
uugacaccauaucugagaaaacatc

SEQ ID NO: 79 - DNA, 25 bp, Artificial Sequence
  Synthetic oligonucleotide
ugacaccauaucugagaaaacauct

SEQ ID NO: 80 - DNA, 25 bp, Artificial Sequence
  Synthetic oligonucleotide
gacaccauaucugagaaaacauctg

SEQ ID NO: 81 - DNA, 25 bp, Artificial Sequence
  Synthetic oligonucleotide
acaccauaucugagaaaacaucuga

SEQ ID NO: 82 - DNA, 25 bp, Artificial Sequence
  Synthetic oligonucleotide
caccauaucugagaaaacaucugat

SEQ ID NO: 83 - DNA, 25 bp, Artificial Sequence
  Synthetic oligonucleotide
accauaucugagaaaacaucugatc

SEQ ID NO: 84 - DNA, 25 bp, Artificial Sequence
  Synthetic oligonucleotide
ccauaucugagaaaacaucugauca

SEQ ID NO: 85 - DNA, 25 bp, Artificial Sequence
  Synthetic oligonucleotide
cauaucugagaaaacaucugaucag

SEQ ID NO: 86 - DNA, 25 bp, Artificial Sequence
  Synthetic oligonucleotide
auaucugagaaaacaucugaucaga

SEQ ID NO: 87 - DNA, 25 bp, Artificial Sequence
  Synthetic oligonucleotide
uaucugagaaaacaucugaucagat

SEQ ID NO: 88 - DNA, 25 bp, Artificial Sequence
  Synthetic oligonucleotide
cugagaaaacaucugaucagaucca

SEQ ID NO: 89 - DNA, 25 bp, Artificial Sequence
  Synthetic oligonucleotide
ugagaaaacaucugaucagauccac

SEQ ID NO: 90 - DNA, 25 bp, Artificial Sequence
  Synthetic oligonucleotide
gagaaaacaucugaucagauccact

SEQ ID NO: 91 - DNA, 25 bp, Artificial Sequence
  Synthetic oligonucleotide
agaaaacaucugaucagauccactt

SEQ ID NO: 92 - DNA, 25 bp, Artificial Sequence
  Synthetic oligonucleotide
aucagauccacuucuucuuugccaa

SEQ ID NO: 93 - DNA, 25 bp, Artificial Sequence
  Synthetic oligonucleotide
cagauccacuucuucuuugccaaac

SEQ ID NO: 94 - DNA, 25 bp, Artificial Sequence
  Synthetic oligonucleotide
agauccacuucuucuuugccaaact

SEQ ID NO: 95 - DNA, 25 bp, Artificial Sequence
  Synthetic oligonucleotide
gauccacuucuucuuugccaaactg

SEQ ID NO: 96 - DNA, 25 bp, Artificial Sequence
  Synthetic oligonucleotide
auccacuucuucuuugccaaacuga

SEQ ID NO: 97 - DNA, 25 bp, Artificial Sequence
  Synthetic oligonucleotide
uccacuucuucuuugccaaacugaa

SEQ ID NO: 98 - DNA, 25 bp, Artificial Sequence
  Synthetic oligonucleotide
ccacuucuucuuugccaaacugaac

SEQ ID NO: 99 - DNA, 25 bp, Artificial Sequence
  Synthetic oligonucleotide
cacuucuucuuugccaaacugaact

SEQ ID NO: 100 - DNA, 25 bp, Artificial Sequence
  Synthetic oligonucleotide
acuucuucuuugccaaacugaactg

SEQ ID NO: 101 - DNA, 25 bp, Artificial Sequence
  Synthetic oligonucleotide
cuucuucuuugccaaacugaacugc

SEQ ID NO: 102 - DNA, 25 bp, Artificial Sequence
  Synthetic oligonucleotide
uucuucuuugccaaacugaacugcc

SEQ ID NO: 103 - DNA, 25 bp, Artificial Sequence
  Synthetic oligonucleotide
ucuucuuugccaaacugaacugccg

SEQ ID NO: 104 - DNA, 25 bp, Artificial Sequence
  Synthetic oligonucleotide
cuucuuugccaaacugaacugccga

SEQ ID NO: 105 - DNA, 25 bp, Artificial Sequence
  Synthetic oligonucleotide
uucuuugccaaacugaacugccgac

SEQ ID NO: 106 - DNA, 25 bp, Artificial Sequence
  Synthetic oligonucleotide
ucuuugccaaacugaacugccgact

SEQ ID NO: 107 - DNA, 25 bp, Artificial Sequence
  Synthetic oligonucleotide
cuuugccaaacugaacugccgactc

SEQ ID NO: 108 - DNA, 25 bp, Artificial Sequence
  Synthetic oligonucleotide
uuugccaaacugaacugccgacuct

SEQ ID NO: 109 - DNA, 25 bp, Artificial Sequence
  Synthetic oligonucleotide
uugccaaacugaacugccgacucta

SEQ ID NO: 110 - DNA, 25 bp, Artificial Sequence
  Synthetic oligonucleotide
ugccaaacugaacugccgacucuat

SEQ ID NO: 111 - DNA, 25 bp, Artificial Sequence
  Synthetic oligonucleotide
gccaaacugaacugccgacucuatc

SEQ ID NO: 112 - DNA, 25 bp, Artificial Sequence
  Synthetic oligonucleotide
ccaaacugaacugccgacucuaucg

SEQ ID NO: 113 - DNA, 25 bp, Artificial Sequence
  Synthetic oligonucleotide
caaacugaacugccgacucuaucga

SEQ ID NO: 114 - DNA, 25 bp, Artificial Sequence
  Synthetic oligonucleotide
aaacugaacugccgacucuaucgaa

SEQ ID NO: 115 - DNA, 25 bp, Artificial Sequence
  Synthetic oligonucleotide
aacugaacugccgacucuaucgaaa

SEQ ID NO: 116 - DNA, 25 bp, Artificial Sequence
  Synthetic oligonucleotide
acugaacugccgacucuaucgaaaa

SEQ ID NO: 117 - DNA, 25 bp, Artificial Sequence
  Synthetic oligonucleotide
cugaacugccgacucuaucgaaaag

SEQ ID NO: 118 - DNA, 25 bp, Artificial Sequence
  Synthetic oligonucleotide
ugaacugccgacucuaucgaaaagc

SEQ ID NO: 119 - DNA, 25 bp, Artificial Sequence
  Synthetic oligonucleotide
gaacugccgacucuaucgaaaagcc

SEQ ID NO: 120 - DNA, 25 bp, Artificial Sequence
  Synthetic oligonucleotide
aacugccgacucuaucgaaaagcca

SEQ ID NO: 121 - DNA, 25 bp, Artificial Sequence
  Synthetic oligonucleotide
acugccgacucuaucgaaaagccaa

SEQ ID NO: 122 - DNA, 25 bp, Artificial Sequence
  Synthetic oligonucleotide
cugccgacucuaucgaaaagccaac

SEQ ID NO: 123 - DNA, 25 bp, Artificial Sequence
  Synthetic oligonucleotide
ugccgacucuaucgaaaagccaaca

SEQ ID NO: 124 - DNA, 25 bp, Artificial Sequence
  Synthetic oligonucleotide
gccgacucuaucgaaaagccaacaa

SEQ ID NO: 125 - DNA, 25 bp, Artificial Sequence
  Synthetic oligonucleotide
ccgacucuaucgaaaagccaacaaa

SEQ ID NO: 126 - DNA, 25 bp, Artificial Sequence
  Synthetic oligonucleotide
cgacucuaucgaaaagccaacaaat

SEQ ID NO: 127 - DNA, 25 bp, Artificial Sequence
  Synthetic oligonucleotide
gacucuaucgaaaagccaacaaatc

SEQ ID NO: 128 - DNA, 25 bp, Artificial Sequence
  Synthetic oligonucleotide
acucuaucgaaaagccaacaaaucc

SEQ ID NO: 129 - DNA, 25 bp, Artificial Sequence
  Synthetic oligonucleotide
cucuaucgaaaagccaacaaaucct

SEQ ID NO: 130 - DNA, 25 bp, Artificial Sequence
  Synthetic oligonucleotide
ucuaucgaaaagccaacaaaucctc

SEQ ID NO: 131 - DNA, 25 bp, Artificial Sequence
  Synthetic oligonucleotide
aaaagccaacaaauccuccaaguta

SEQ ID NO: 132 - DNA, 25 bp, Artificial Sequence
  Synthetic oligonucleotide
aaagccaacaaauccuccaaguuag

SEQ ID NO: 133 - DNA, 25 bp, Artificial Sequence
  Synthetic oligonucleotide
gccaacaaauccuccaaguuaguat

SEQ ID NO: 134 - DNA, 25 bp, Artificial Sequence
  Synthetic oligonucleotide
ccaacaaauccuccaaguuaguatc

SEQ ID NO: 135 - DNA, 25 bp, Artificial Sequence
  Synthetic oligonucleotide
caacaaauccuccaaguuaguauca

SEQ ID NO: 136 - DNA, 25 bp, Artificial Sequence
  Synthetic oligonucleotide
aacaaauccuccaaguuaguaucag

SEQ ID NO: 137 - DNA, 25 bp, Artificial Sequence
  Synthetic oligonucleotide
acaaauccuccaaguuaguaucagc

SEQ ID NO: 138 - DNA, 25 bp, Artificial Sequence
  Synthetic oligonucleotide
caaauccuccaaguuaguaucagcc

SEQ ID NO: 139 - DNA, 25 bp, Artificial Sequence
  Synthetic oligonucleotide
aguuaguaucagccaaucgccuutt

SEQ ID NO: 140 - DNA, 25 bp, Artificial Sequence
  Synthetic oligonucleotide
aguaucagccaaucgccuuuuugga

SEQ ID NO: 141 - DNA, 25 bp, Artificial Sequence
  Synthetic oligonucleotide
cagccaaucgccuuuuuggagacaa

SEQ ID NO: 142 - DNA, 25 bp, Artificial Sequence
  Synthetic oligonucleotide
agccaaucgccuuuuuggagacaaa

SEQ ID NO: 143 - DNA, 25 bp, Artificial Sequence
  Synthetic oligonucleotide
gccaaucgccuuuuuggagacaaat

SEQ ID NO: 144 - DNA, 25 bp, Artificial Sequence
  Synthetic oligonucleotide
aucgccuuuuuggagacaaauccct

SEQ ID NO: 145 - DNA, 25 bp, Artificial Sequence
  Synthetic oligonucleotide
cgccuuuuuggagacaaaucccuta

SEQ ID NO: 146 - DNA, 25 bp, Artificial Sequence
  Synthetic oligonucleotide
gccuuuuuggagacaaaucccuuac

SEQ ID NO: 147 - DNA, 25 bp, Artificial Sequence
  Synthetic oligonucleotide
ccuuuuuggagacaaaucccuuacc

SEQ ID NO: 148 - DNA, 25 bp, Artificial Sequence
  Synthetic oligonucleotide
cuuuuuggagacaaaucccuuacct

SEQ ID NO: 149 - DNA, 25 bp, Artificial Sequence
  Synthetic oligonucleotide
uuuuuggagacaaaucccuuacctt

SEQ ID NO: 150 - DNA, 25 bp, Artificial Sequence
  Synthetic oligonucleotide
uggagacaaaucccuuaccuucaat

SEQ ID NO: 151 - DNA, 25 bp, Artificial Sequence
  Synthetic oligonucleotide
ggagacaaaucccuuaccuucaatg

SEQ ID NO: 152 - DNA, 25 bp, Artificial Sequence
  Synthetic oligonucleotide
gagacaaaucccuuaccuucaauga

SEQ ID NO: 153 - DNA, 25 bp, Artificial Sequence
  Synthetic oligonucleotide
agacaaaucccuuaccuucaaugag

SEQ ID NO: 154 - DNA, 25 bp, Artificial Sequence
  Synthetic oligonucleotide
gacaaaucccuuaccuucaaugaga

SEQ ID NO: 155 - DNA, 25 bp, Artificial Sequence
  Synthetic oligonucleotide
acaaaucccuuaccuucaaugagac

SEQ ID NO: 156 - DNA, 25 bp, Artificial Sequence
  Synthetic oligonucleotide
aaaucccuuaccuucaaugagacct

SEQ ID NO: 157 - DNA, 25 bp, Artificial Sequence
  Synthetic oligonucleotide
aaucccuuaccuucaaugagaccta

SEQ ID NO: 158 - DNA, 25 bp, Artificial Sequence
  Synthetic oligonucleotide
aucccuuaccuucaaugagaccuac

SEQ ID NO: 159 - DNA, 25 bp, Artificial Sequence
  Synthetic oligonucleotide
accuucaaugagaccuaccaggaca

SEQ ID NO: 160 - DNA, 25 bp, Artificial Sequence
  Synthetic oligonucleotide
ucaaugagaccuaccaggacaucag

SEQ ID NO: 161 - DNA, 25 bp, Artificial Sequence
  Synthetic oligonucleotide
caaugagaccuaccaggacaucagt

SEQ ID NO: 162 - DNA, 25 bp, Artificial Sequence
  Synthetic oligonucleotide
aaugagaccuaccaggacaucagtg

SEQ ID NO: 163 - DNA, 25 bp, Artificial Sequence
  Synthetic oligonucleotide
ugagaccuaccaggacaucagugag

SEQ ID NO: 164 - DNA, 25 bp, Artificial Sequence
  Synthetic oligonucleotide
agaccuaccaggacaucagugagtt

SEQ ID NO: 165 - DNA, 25 bp, Artificial Sequence
  Synthetic oligonucleotide
cuaccaggacaucagugaguuggta

SEQ ID NO: 166 - DNA, 25 bp, Artificial Sequence
  Synthetic oligonucleotide
uaccaggacaucagugaguugguat

SEQ ID NO: 167 - DNA, 25 bp, Artificial Sequence
  Synthetic oligonucleotide
accaggacaucagugaguugguata

SEQ ID NO: 168 - DNA, 25 bp, Artificial Sequence
  Synthetic oligonucleotide
ccaggacaucagugaguugguauat

SEQ ID NO: 169 - DNA, 25 bp, Artificial Sequence
  Synthetic oligonucleotide
caggacaucagugaguugguauatg

SEQ ID NO: 170 - DNA, 25 bp, Artificial Sequence
  Synthetic oligonucleotide
aggacaucagugaguugguauaugg

SEQ ID NO: 171 - DNA, 25 bp, Artificial Sequence
  Synthetic oligonucleotide
ggacaucagugaguugguauaugga

SEQ ID NO: 172 - DNA, 25 bp, Artificial Sequence
  Synthetic oligonucleotide
gacaucagugaguugguauauggag

SEQ ID NO: 173 - DNA, 25 bp, Artificial Sequence
  Synthetic oligonucleotide
acaucagugaguugguauauggagc

SEQ ID NO: 174 - DNA, 25 bp, Artificial Sequence
  Synthetic oligonucleotide
uauggagccaagcuccagccccugg

SEQ ID NO: 175 - DNA, 25 bp, Artificial Sequence
  Synthetic oligonucleotide
auggagccaagcuccagccccugga

SEQ ID NO: 176 - DNA, 25 bp, Artificial Sequence
  Synthetic oligonucleotide
uggagccaagcuccagccccuggac

SEQ ID NO: 177 - DNA, 25 bp, Artificial Sequence
  Synthetic oligonucleotide
ggagccaagcuccagccccuggact

SEQ ID NO: 178 - DNA, 25 bp, Artificial Sequence
  Synthetic oligonucleotide
gagccaagcuccagccccuggactt

SEQ ID NO: 179 - DNA, 25 bp, Artificial Sequence
  Synthetic oligonucleotide
agccaagcuccagccccuggacutc

SEQ ID NO: 180 - DNA, 25 bp, Artificial Sequence
  Synthetic oligonucleotide
gccaagcuccagccccuggacuuca

SEQ ID NO: 181 - DNA, 25 bp, Artificial Sequence
  Synthetic oligonucleotide
ccaagcuccagccccuggacuucaa

SEQ ID NO: 182 - DNA, 25 bp, Artificial Sequence
  Synthetic oligonucleotide
caagcuccagccccuggacuucaag

SEQ ID NO: 183 - DNA, 25 bp, Artificial Sequence
  Synthetic oligonucleotide
aagcuccagccccuggacuucaagg

SEQ ID NO: 184 - DNA, 25 bp, Artificial Sequence
  Synthetic oligonucleotide
agcuccagccccuggacuucaagga

SEQ ID NO: 185 - DNA, 25 bp, Artificial Sequence
  Synthetic oligonucleotide
gcuccagccccuggacuucaaggaa

SEQ ID NO: 186 - DNA, 25 bp, Artificial Sequence
  Synthetic oligonucleotide
cuccagccccuggacuucaaggaaa

SEQ ID NO: 187 - DNA, 25 bp, Artificial Sequence
  Synthetic oligonucleotide
uccagccccuggacuucaaggaaaa

SEQ ID NO: 188 - DNA, 25 bp, Artificial Sequence
  Synthetic oligonucleotide
ccagccccuggacuucaaggaaaat

SEQ ID NO: 189 - DNA, 25 bp, Artificial Sequence
  Synthetic oligonucleotide
cagccccuggacuucaaggaaaatg

SEQ ID NO: 190 - DNA, 25 bp, Artificial Sequence
  Synthetic oligonucleotide
agccccuggacuucaaggaaaaugc

SEQ ID NO: 191 - DNA, 25 bp, Artificial Sequence
  Synthetic oligonucleotide
gccccuggacuucaaggaaaaugca

SEQ ID NO: 192 - DNA, 25 bp, Artificial Sequence
  Synthetic oligonucleotide
uggacuucaaggaaaaugcagagca

SEQ ID NO: 193 - DNA, 25 bp, Artificial Sequence
  Synthetic oligonucleotide
ggacuucaaggaaaaugcagagcaa

SEQ ID NO: 194 - DNA, 25 bp, Artificial Sequence
  Synthetic oligonucleotide
gacuucaaggaaaaugcagagcaat

SEQ ID NO: 195 - DNA, 25 bp, Artificial Sequence
  Synthetic oligonucleotide
acuucaaggaaaaugcagagcaatc

SEQ ID NO: 196 - DNA, 25 bp, Artificial Sequence
  Synthetic oligonucleotide
uucaaggaaaaugcagagcaaucca

SEQ ID NO: 197 - DNA, 25 bp, Artificial Sequence
  Synthetic oligonucleotide
ucaaggaaaaugcagagcaauccag

SEQ ID NO: 198 - DNA, 25 bp, Artificial Sequence
  Synthetic oligonucleotide
caaggaaaaugcagagcaauccaga

SEQ ID NO: 199 - DNA, 25 bp, Artificial Sequence
  Synthetic oligonucleotide
aaggaaaaugcagagcaauccagag

SEQ ID NO: 200 - DNA, 25 bp, Artificial Sequence
  Synthetic oligonucleotide
caucaacaaauggguguccaauaag

SEQ ID NO: 201 - DNA, 25 bp, Artificial Sequence
  Synthetic oligonucleotide
aucaacaaauggguguccaauaaga

SEQ ID NO: 202 - DNA, 25 bp, Artificial Sequence
  Synthetic oligonucleotide
caaauggguguccaauaagaccgaa

SEQ ID NO: 203 - DNA, 25 bp, Artificial Sequence
  Synthetic oligonucleotide
gagcucacuguucuggugcugguta

SEQ ID NO: 204 - DNA, 25 bp, Artificial Sequence
  Synthetic oligonucleotide
gcucacuguucuggugcugguuaac

SEQ ID NO: 205 - DNA, 25 bp, Artificial Sequence
  Synthetic oligonucleotide
cucacuguucuggugcugguuaaca

SEQ ID NO: 206 - DNA, 25 bp, Artificial Sequence
  Synthetic oligonucleotide
ucacuguucuggugcugguuaacac

SEQ ID NO: 207 - DNA, 25 bp, Artificial Sequence
  Synthetic oligonucleotide
cacuguucuggugcugguuaacacc

SEQ ID NO: 208 - DNA, 25 bp, Artificial Sequence
  Synthetic oligonucleotide
acuguucuggugcugguuaacacca

SEQ ID NO: 209 - DNA, 25 bp, Artificial Sequence
  Synthetic oligonucleotide
cuguucuggugcugguuaacaccat

SEQ ID NO: 210 - DNA, 25 bp, Artificial Sequence
  Synthetic oligonucleotide
uguucuggugcugguuaacaccatt

SEQ ID NO: 211 - DNA, 25 bp, Artificial Sequence
  Synthetic oligonucleotide
guucuggugcugguuaacaccautt

SEQ ID NO: 212 - DNA, 25 bp, Artificial Sequence
  Synthetic oligonucleotide
uucuggugcugguuaacaccauuta

SEQ ID NO: 213 - DNA, 25 bp, Artificial Sequence
  Synthetic oligonucleotide
ucuggugcugguuaacaccauuuac

SEQ ID NO: 214 - DNA, 25 bp, Artificial Sequence
  Synthetic oligonucleotide
cuggugcugguuaacaccauuuact

SEQ ID NO: 215 - DNA, 25 bp, Artificial Sequence
  Synthetic oligonucleotide
uggugcugguuaacaccauuuactt

SEQ ID NO: 216 - DNA, 25 bp, Artificial Sequence
  Synthetic oligonucleotide
ggugcugguuaacaccauuuacutc

SEQ ID NO: 217 - DNA, 25 bp, Artificial Sequence
  Synthetic oligonucleotide
gugcugguuaacaccauuuacuuca

SEQ ID NO: 218 - DNA, 25 bp, Artificial Sequence
  Synthetic oligonucleotide
ugcugguuaacaccauuuacuucaa

SEQ ID NO: 219 - DNA, 25 bp, Artificial Sequence
  Synthetic oligonucleotide
gcugguuaacaccauuuacuucaag

SEQ ID NO: 220 - DNA, 25 bp, Artificial Sequence
  Synthetic oligonucleotide
cugguuaacaccauuuacuucaagg

SEQ ID NO: 221 - DNA, 25 bp, Artificial Sequence
  Synthetic oligonucleotide
ugguuaacaccauuuacuucaaggg

SEQ ID NO: 222 - DNA, 25 bp, Artificial Sequence
  Synthetic oligonucleotide
gguuaacaccauuuacuucaagggc

SEQ ID NO: 223 - DNA, 25 bp, Artificial Sequence
  Synthetic oligonucleotide
guuaacaccauuuacuucaagggcc

SEQ ID NO: 224 - DNA, 25 bp, Artificial Sequence
  Synthetic oligonucleotide
uuaacaccauuuacuucaagggcct

SEQ ID NO: 225 - DNA, 25 bp, Artificial Sequence
  Synthetic oligonucleotide
uaacaccauuuacuucaagggcctg

SEQ ID NO: 226 - DNA, 25 bp, Artificial Sequence
  Synthetic oligonucleotide
aacaccauuuacuucaagggccugt

SEQ ID NO: 227 - DNA, 25 bp, Artificial Sequence
  Synthetic oligonucleotide
acaccauuuacuucaagggccugtg

SEQ ID NO: 228 - DNA, 25 bp, Artificial Sequence
  Synthetic oligonucleotide
caccauuuacuucaagggccugugg

SEQ ID NO: 229 - DNA, 25 bp, Artificial Sequence
  Synthetic oligonucleotide
accauuuacuucaagggccugugga

SEQ ID NO: 230 - DNA, 25 bp, Artificial Sequence
  Synthetic oligonucleotide
ccauuuacuucaagggccuguggaa

SEQ ID NO: 231 - DNA, 25 bp, Artificial Sequence
  Synthetic oligonucleotide
cauuuacuucaagggccuguggaag

SEQ ID NO: 232 - DNA, 25 bp, Artificial Sequence
  Synthetic oligonucleotide
auuuacuucaagggccuguggaagt

SEQ ID NO: 233 - DNA, 25 bp, Artificial Sequence
  Synthetic oligonucleotide
uuuacuucaagggccuguggaagtc

SEQ ID NO: 234 - DNA, 25 bp, Artificial Sequence
  Synthetic oligonucleotide
uuacuucaagggccuguggaaguca

SEQ ID NO: 235 - DNA, 25 bp, Artificial Sequence
  Synthetic oligonucleotide
uacuucaagggccuguggaagucaa

SEQ ID NO: 236 - DNA, 25 bp, Artificial Sequence
  Synthetic oligonucleotide
acuucaagggccuguggaagucaaa

SEQ ID NO: 237 - DNA, 25 bp, Artificial Sequence
  Synthetic oligonucleotide
cuucaagggccuguggaagucaaag

SEQ ID NO: 238 - DNA, 25 bp, Artificial Sequence
  Synthetic oligonucleotide
uucaagggccuguggaagucaaagt

SEQ ID NO: 239 - DNA, 25 bp, Artificial Sequence
  Synthetic oligonucleotide
ucaagggccuguggaagucaaagtt

SEQ ID NO: 240 - DNA, 25 bp, Artificial Sequence
  Synthetic oligonucleotide
caagggccuguggaagucaaagutc

SEQ ID NO: 241 - DNA, 25 bp, Artificial Sequence
  Synthetic oligonucleotide
aagggccuguggaagucaaaguuca

SEQ ID NO: 242 - DNA, 25 bp, Artificial Sequence
  Synthetic oligonucleotide
agggccuguggaagucaaaguucag

SEQ ID NO: 243 - DNA, 25 bp, Artificial Sequence
  Synthetic oligonucleotide
gggccuguggaagucaaaguucagc

SEQ ID NO: 244 - DNA, 25 bp, Artificial Sequence
  Synthetic oligonucleotide
ggccuguggaagucaaaguucagcc

SEQ ID NO: 245 - DNA, 25 bp, Artificial Sequence
  Synthetic oligonucleotide
gccuguggaagucaaaguucagccc

SEQ ID NO: 246 - DNA, 25 bp, Artificial Sequence
  Synthetic oligonucleotide
ccuguggaagucaaaguucagccct

SEQ ID NO: 247 - DNA, 25 bp, Artificial Sequence
  Synthetic oligonucleotide
cuguggaagucaaaguucagccctg

SEQ ID NO: 248 - DNA, 25 bp, Artificial Sequence
  Synthetic oligonucleotide
uguggaagucaaaguucagcccuga

SEQ ID NO: 249 - DNA, 25 bp, Artificial Sequence
  Synthetic oligonucleotide
guggaagucaaaguucagcccugag

SEQ ID NO: 250 - DNA, 25 bp, Artificial Sequence
  Synthetic oligonucleotide
uggaagucaaaguucagcccugaga

SEQ ID NO: 251 - DNA, 25 bp, Artificial Sequence
  Synthetic oligonucleotide
ggaagucaaaguucagcccugagaa

SEQ ID NO: 252 - DNA, 25 bp, Artificial Sequence
  Synthetic oligonucleotide
gaagucaaaguucagcccugagaac

SEQ ID NO: 253 - DNA, 25 bp, Artificial Sequence
  Synthetic oligonucleotide
aagucaaaguucagcccugagaaca

SEQ ID NO: 254 - DNA, 25 bp, Artificial Sequence
  Synthetic oligonucleotide
agucaaaguucagcccugagaacac

SEQ ID NO: 255 - DNA, 25 bp, Artificial Sequence
  Synthetic oligonucleotide
caaggcugauggagagucguguuca

SEQ ID NO: 256 - DNA, 25 bp, Artificial Sequence
  Synthetic oligonucleotide
gauggagagucguguucagcaucta

SEQ ID NO: 257 - DNA, 25 bp, Artificial Sequence
  Synthetic oligonucleotide
auggagagucguguucagcaucuat

SEQ ID NO: 258 - DNA, 25 bp, Artificial Sequence
  Synthetic oligonucleotide
cuaugauguaccaggaaggcaagtt

SEQ ID NO: 259 - DNA, 25 bp, Artificial Sequence
  Synthetic oligonucleotide
uaugauguaccaggaaggcaagutc

SEQ ID NO: 260 - DNA, 25 bp, Artificial Sequence
  Synthetic oligonucleotide
augauguaccaggaaggcaaguucc

SEQ ID NO: 261 - DNA, 25 bp, Artificial Sequence
  Synthetic oligonucleotide
ugauguaccaggaaggcaaguuccg

SEQ ID NO: 262 - DNA, 25 bp, Artificial Sequence
  Synthetic oligonucleotide
auguaccaggaaggcaaguuccgtt

SEQ ID NO: 263 - DNA, 25 bp, Artificial Sequence
  Synthetic oligonucleotide
ccaggugcuugaguugcccuucaaa

SEQ ID NO: 264 - DNA, 25 bp, Artificial Sequence
  Synthetic oligonucleotide
ggugcuugaguugcccuucaaaggt

SEQ ID NO: 265 - DNA, 25 bp, Artificial Sequence
  Synthetic oligonucleotide
gugcuugaguugcccuucaaaggtg

SEQ ID NO: 266 - DNA, 25 bp, Artificial Sequence
  Synthetic oligonucleotide
ugcuugaguugcccuucaaagguga

SEQ ID NO: 267 - DNA, 25 bp, Artificial Sequence
  Synthetic oligonucleotide
ggugaugacaucaccaugguccuca

SEQ ID NO: 268 - DNA, 25 bp, Artificial Sequence
  Synthetic oligonucleotide
gugaugacaucaccaugguccucat

SEQ ID NO: 269 - DNA, 25 bp, Artificial Sequence
  Synthetic oligonucleotide
ugcccaagccugagaagagccuggc

SEQ ID NO: 270 - DNA, 25 bp, Artificial Sequence
  Synthetic oligonucleotide
gcccaagccugagaagagccuggcc

SEQ ID NO: 271 - DNA, 25 bp, Artificial Sequence
  Synthetic oligonucleotide
cccaagccugagaagagccuggcca

SEQ ID NO: 272 - DNA, 25 bp, Artificial Sequence
  Synthetic oligonucleotide
ccaagccugagaagagccuggccaa

SEQ ID NO: 273 - DNA, 25 bp, Artificial Sequence
  Synthetic oligonucleotide
caagccugagaagagccuggccaag

SEQ ID NO: 274 - DNA, 25 bp, Artificial Sequence
  Synthetic oligonucleotide
aagccugagaagagccuggccaagg

SEQ ID NO: 275 - DNA, 25 bp, Artificial Sequence
  Synthetic oligonucleotide
agccugagaagagccuggccaaggt

SEQ ID NO: 276 - DNA, 25 bp, Artificial Sequence
  Synthetic oligonucleotide
gccugagaagagccuggccaaggta

SEQ ID NO: 277 - DNA, 25 bp, Artificial Sequence
  Synthetic oligonucleotide
ccugagaagagccuggccaagguag

SEQ ID NO: 278 - DNA, 25 bp, Artificial Sequence
  Synthetic oligonucleotide
cugagaagagccuggccaagguaga

SEQ ID NO: 279 - DNA, 25 bp, Artificial Sequence
  Synthetic oligonucleotide
ugagaagagccuggccaagguagag

SEQ ID NO: 280 - DNA, 25 bp, Artificial Sequence
  Synthetic oligonucleotide
gagaagagccuggccaagguagaga

SEQ ID NO: 281 - DNA, 25 bp, Artificial Sequence
  Synthetic oligonucleotide
agaagagccuggccaagguagagaa

SEQ ID NO: 282 - DNA, 25 bp, Artificial Sequence
  Synthetic oligonucleotide
gugguccacaugccccgcuuccgca

SEQ ID NO: 283 - DNA, 25 bp, Artificial Sequence
  Synthetic oligonucleotide
ugguccacaugccccgcuuccgcat

SEQ ID NO: 284 - DNA, 25 bp, Artificial Sequence
  Synthetic oligonucleotide
gguccacaugccccgcuuccgcatt

SEQ ID NO: 285 - DNA, 25 bp, Artificial Sequence
  Synthetic oligonucleotide
guccacaugccccgcuuccgcautg

SEQ ID NO: 286 - DNA, 25 bp, Artificial Sequence
  Synthetic oligonucleotide
uccacaugccccgcuuccgcauuga

SEQ ID NO: 287 - DNA, 25 bp, Artificial Sequence
  Synthetic oligonucleotide
ccacaugccccgcuuccgcauugag

SEQ ID NO: 288 - DNA, 25 bp, Artificial Sequence
  Synthetic oligonucleotide
cacaugccccgcuuccgcauugagg

SEQ ID NO: 289 - DNA, 25 bp, Artificial Sequence
  Synthetic oligonucleotide
aguuugaaggagcagcugcaagaca

SEQ ID NO: 290 - DNA, 25 bp, Artificial Sequence
  Synthetic oligonucleotide
guuugaaggagcagcugcaagacat

SEQ ID NO: 291 - DNA, 25 bp, Artificial Sequence
  Synthetic oligonucleotide
ugaaggagcagcugcaagacauggg

SEQ ID NO: 292 - DNA, 25 bp, Artificial Sequence
  Synthetic oligonucleotide
gaaggagcagcugcaagacaugggc

SEQ ID NO: 293 - DNA, 25 bp, Artificial Sequence
  Synthetic oligonucleotide
aaggagcagcugcaagacaugggcc

SEQ ID NO: 294 - DNA, 25 bp, Artificial Sequence
  Synthetic oligonucleotide
aggagcagcugcaagacaugggcct

SEQ ID NO: 295 - DNA, 25 bp, Artificial Sequence
  Synthetic oligonucleotide
ggagcagcugcaagacaugggcctt

SEQ ID NO: 296 - DNA, 25 bp, Artificial Sequence
  Synthetic oligonucleotide
gagcagcugcaagacaugggccutg

SEQ ID NO: 297 - DNA, 25 bp, Artificial Sequence
  Synthetic oligonucleotide
agcagcugcaagacaugggccuugt

SEQ ID NO: 298 - DNA, 25 bp, Artificial Sequence
  Synthetic oligonucleotide
gcagcugcaagacaugggccuugtc

SEQ ID NO: 299 - DNA, 25 bp, Artificial Sequence
  Synthetic oligonucleotide
cagcugcaagacaugggccuugucg

SEQ ID NO: 300 - DNA, 25 bp, Artificial Sequence
  Synthetic oligonucleotide
agcugcaagacaugggccuugucga

SEQ ID NO: 301 - DNA, 25 bp, Artificial Sequence
  Synthetic oligonucleotide
uugucgaucuguucagcccugaaaa

SEQ ID NO: 302 - DNA, 25 bp, Artificial Sequence
  Synthetic oligonucleotide
gucgaucuguucagcccugaaaagt

SEQ ID NO: 303 - DNA, 25 bp, Artificial Sequence
  Synthetic oligonucleotide
ucgaucuguucagcccugaaaagtc

SEQ ID NO: 304 - DNA, 25 bp, Artificial Sequence
  Synthetic oligonucleotide
gaucuguucagcccugaaaagucca

SEQ ID NO: 305 - DNA, 25 bp, Artificial Sequence
  Synthetic oligonucleotide
cuguucagcccugaaaaguccaaac

SEQ ID NO: 306 - DNA, 25 bp, Artificial Sequence
  Synthetic oligonucleotide
guucagcccugaaaaguccaaactc

SEQ ID NO: 307 - DNA, 25 bp, Artificial Sequence
  Synthetic oligonucleotide
aaaguccaaacucccagguauugtt

SEQ ID NO: 308 - DNA, 25 bp, Artificial Sequence
  Synthetic oligonucleotide
aaguccaaacucccagguauugutg

SEQ ID NO: 309 - DNA, 25 bp, Artificial Sequence
  Synthetic oligonucleotide
guccaaacucccagguauuguugca

SEQ ID NO: 310 - DNA, 25 bp, Artificial Sequence
  Synthetic oligonucleotide
ccaaacucccagguauuguugcaga

SEQ ID NO: 311 - DNA, 25 bp, Artificial Sequence
  Synthetic oligonucleotide
caaacucccagguauuguugcagaa

SEQ ID NO: 312 - DNA, 25 bp, Artificial Sequence
  Synthetic oligonucleotide
aaacucccagguauuguugcagaag

SEQ ID NO: 313 - DNA, 25 bp, Artificial Sequence
  Synthetic oligonucleotide
aacucccagguauuguugcagaagg

SEQ ID NO: 314 - DNA, 25 bp, Artificial Sequence
  Synthetic oligonucleotide
cauaaggcauuucuugagguaaatg

SEQ ID NO: 315 - DNA, 25 bp, Artificial Sequence
  Synthetic oligonucleotide
auaaggcauuucuugagguaaauga

SEQ ID NO: 316 - DNA, 25 bp, Artificial Sequence
  Synthetic oligonucleotide
uaaggcauuucuugagguaaaugaa

SEQ ID NO: 317 - DNA, 25 bp, Artificial Sequence
  Synthetic oligonucleotide
aaggcauuucuugagguaaaugaag

SEQ ID NO: 318 - DNA, 25 bp, Artificial Sequence
  Synthetic oligonucleotide
aggcauuucuugagguaaaugaaga

SEQ ID NO: 319 - DNA, 25 bp, Artificial Sequence
  Synthetic oligonucleotide
ggcauuucuugagguaaaugaagaa

SEQ ID NO: 320 - DNA, 25 bp, Artificial Sequence
  Synthetic oligonucleotide
gcauuucuugagguaaaugaagaag

SEQ ID NO: 321 - DNA, 25 bp, Artificial Sequence
  Synthetic oligonucleotide
cauuucuugagguaaaugaagaagg

SEQ ID NO: 322 - DNA, 25 bp, Artificial Sequence
  Synthetic oligonucleotide
ugagguaaaugaagaaggcagugaa

SEQ ID NO: 323 - DNA, 25 bp, Artificial Sequence
  Synthetic oligonucleotide
gagguaaaugaagaaggcagugaag

SEQ ID NO: 324 - DNA, 25 bp, Artificial Sequence
  Synthetic oligonucleotide
agguaaaugaagaaggcagugaagc

SEQ ID NO: 325 - DNA, 25 bp, Artificial Sequence
  Synthetic oligonucleotide
gguaaaugaagaaggcagugaagca

SEQ ID NO: 326 - DNA, 25 bp, Artificial Sequence
  Synthetic oligonucleotide
guaaaugaagaaggcagugaagcag

SEQ ID NO: 327 - DNA, 25 bp, Artificial Sequence
  Synthetic oligonucleotide
uaaaugaagaaggcagugaagcagc

SEQ ID NO: 328 - DNA, 25 bp, Artificial Sequence
  Synthetic oligonucleotide
aaaugaagaaggcagugaagcagct

SEQ ID NO: 329 - DNA, 25 bp, Artificial Sequence
  Synthetic oligonucleotide
aagaaggcagugaagcagcugcaag

SEQ ID NO: 330 - DNA, 25 bp, Artificial Sequence
  Synthetic oligonucleotide
aaggcagugaagcagcugcaaguac

SEQ ID NO: 331 - DNA, 25 bp, Artificial Sequence
  Synthetic oligonucleotide
aggcagugaagcagcugcaaguacc

SEQ ID NO: 332 - DNA, 25 bp, Artificial Sequence
  Synthetic oligonucleotide
aagcagcugcaaguaccgcuguugt

SEQ ID NO: 333 - DNA, 25 bp, Artificial Sequence
  Synthetic oligonucleotide
aacaggccuuuccugguuuuuauaa

SEQ ID NO: 334 - DNA, 25 bp, Artificial Sequence
  Synthetic oligonucleotide
acaggccuuuccugguuuuuauaag

SEQ ID NO: 335 - DNA, 25 bp, Artificial Sequence
  Synthetic oligonucleotide
caggccuuuccugguuuuuauaaga

SEQ ID NO: 336 - DNA, 25 bp, Artificial Sequence
  Synthetic oligonucleotide
aggccuuuccugguuuuuauaagag

SEQ ID NO: 337 - DNA, 25 bp, Artificial Sequence
  Synthetic oligonucleotide
ggccuuuccugguuuuuauaagaga

SEQ ID NO: 338 - DNA, 25 bp, Artificial Sequence
  Synthetic oligonucleotide
gccuuuccugguuuuuauaagagaa

SEQ ID NO: 339 - DNA, 25 bp, Artificial Sequence
  Synthetic oligonucleotide
cuuuccugguuuuuauaagagaagt

SEQ ID NO: 340 - DNA, 25 bp, Artificial Sequence
  Synthetic oligonucleotide
uuuccugguuuuuauaagagaagtt

SEQ ID NO: 341 - DNA, 25 bp, Artificial Sequence
  Synthetic oligonucleotide
uuccugguuuuuauaagagaagutc

SEQ ID NO: 342 - DNA, 25 bp, Artificial Sequence
  Synthetic oligonucleotide
uccugguuuuuauaagagaaguucc

SEQ ID NO: 343 - DNA, 25 bp, Artificial Sequence
  Synthetic oligonucleotide
ccugguuuuuauaagagaaguucct

SEQ ID NO: 344 - DNA, 25 bp, Artificial Sequence
  Synthetic oligonucleotide
cugguuuuuauaagagaaguucctc

SEQ ID NO: 345 - DNA, 25 bp, Artificial Sequence
  Synthetic oligonucleotide
ugguuuuuauaagagaaguuccuct

SEQ ID NO: 346 - DNA, 25 bp, Artificial Sequence
  Synthetic oligonucleotide
gguuuuuauaagagaaguuccuctg

SEQ ID NO: 347 - DNA, 25 bp, Artificial Sequence
  Synthetic oligonucleotide
guuuuuauaagagaaguuccucuga

SEQ ID NO: 348 - DNA, 25 bp, Artificial Sequence
  Synthetic oligonucleotide
uuuuuauaagagaaguuccucugaa

SEQ ID NO: 349 - DNA, 25 bp, Artificial Sequence
  Synthetic oligonucleotide
uuuuauaagagaaguuccucugaac

SEQ ID NO: 350 - DNA, 25 bp, Artificial Sequence
  Synthetic oligonucleotide
uuuauaagagaaguuccucugaaca

SEQ ID NO: 351 - DNA, 25 bp, Artificial Sequence
  Synthetic oligonucleotide
uuauaagagaaguuccucugaacac

SEQ ID NO: 352 - DNA, 25 bp, Artificial Sequence
  Synthetic oligonucleotide
uauaagagaaguuccucugaacact

SEQ ID NO: 353 - DNA, 25 bp, Artificial Sequence
  Synthetic oligonucleotide
auaagagaaguuccucugaacacta

SEQ ID NO: 354 - DNA, 25 bp, Artificial Sequence
  Synthetic oligonucleotide
uaagagaaguuccucugaacacuat

SEQ ID NO: 355 - DNA, 25 bp, Artificial Sequence
  Synthetic oligonucleotide
aagagaaguuccucugaacacuatt

SEQ ID NO: 356 - DNA, 25 bp, Artificial Sequence
  Synthetic oligonucleotide
agagaaguuccucugaacacuauta

SEQ ID NO: 357 - DNA, 25 bp, Artificial Sequence
  Synthetic oligonucleotide
gagaaguuccucugaacacuauuat

SEQ ID NO: 358 - DNA, 25 bp, Artificial Sequence
  Synthetic oligonucleotide
agaaguuccucugaacacuauuatc

SEQ ID NO: 359 - DNA, 25 bp, Artificial Sequence
  Synthetic oligonucleotide
gaaguuccucugaacacuauuauct

SEQ ID NO: 360 - DNA, 25 bp, Artificial Sequence
  Synthetic oligonucleotide
aaguuccucugaacacuauuauctt

SEQ ID NO: 361 - DNA, 25 bp, Artificial Sequence
  Synthetic oligonucleotide
aguuccucugaacacuauuaucutc

SEQ ID NO: 362 - DNA, 25 bp, Artificial Sequence
  Synthetic oligonucleotide
guuccucugaacacuauuaucuuca

SEQ ID NO: 363 - DNA, 25 bp, Artificial Sequence
  Synthetic oligonucleotide
uuccucugaacacuauuaucuucat

SEQ ID NO: 364 - DNA, 25 bp, Artificial Sequence
  Synthetic oligonucleotide
uccucugaacacuauuaucuucatg

SEQ ID NO: 365 - DNA, 25 bp, Artificial Sequence
  Synthetic oligonucleotide
ccucugaacacuauuaucuucaugg

SEQ ID NO: 366 - DNA, 25 bp, Artificial Sequence
  Synthetic oligonucleotide
cucugaacacuauuaucuucauggg

SEQ ID NO: 367 - DNA, 25 bp, Artificial Sequence
  Synthetic oligonucleotide
cugaacacuauuaucuucaugggca

SEQ ID NO: 368 - DNA, 25 bp, Artificial Sequence
  Synthetic oligonucleotide
cacuauuaucuucaugggcagagta

SEQ ID NO: 369 - DNA, 25 bp, Artificial Sequence
  Synthetic oligonucleotide
agaaguaaaaauaaauacaaacuac

SEQ ID NO: 370 - DNA, 25 bp, Artificial Sequence
  Synthetic oligonucleotide
gaaguaaaaauaaauacaaacuact

SEQ ID NO: 371 - DNA, 25 bp, Artificial Sequence
  Synthetic oligonucleotide
ggugagauauaagacauaaucagaa

SEQ ID NO: 372 - DNA, 25 bp, Artificial Sequence
  Synthetic oligonucleotide
agcagcugauggagguuuuuaaatt

SEQ ID NO: 373 - DNA, 25 bp, Artificial Sequence
  Synthetic oligonucleotide
auggagguuuuuaaauuugauacca

SEQ ID NO: 374 - DNA, 25 bp, Artificial Sequence
  Synthetic oligonucleotide
ggaaguugcacugaacacuauuata

SEQ ID NO: 375 - DNA, 25 bp, Artificial Sequence
  Synthetic oligonucleotide
aguugcacugaacacuauuauautc

SEQ ID NO: 376 - DNA, 25 bp, Artificial Sequence
  Synthetic oligonucleotide
uugcacugaacacuauuauauucat

SEQ ID NO: 377 - DNA, 25 bp, Artificial Sequence
  Synthetic oligonucleotide
cuuugguguuugugaauagaaguaa

SEQ ID NO: 378 - DNA, 25 bp, Artificial Sequence
  Synthetic oligonucleotide
gguguuugugaauagaaguaaaaat

SEQ ID NO: 379 - DNA, 25 bp, Artificial Sequence
  Synthetic oligonucleotide
guguuugugaauagaaguaaaaata

SEQ ID NO: 380 - DNA, 25 bp, Artificial Sequence
  Synthetic oligonucleotide
uguuugugaauagaaguaaaaauaa

SEQ ID NO: 381 - DNA, 25 bp, Artificial Sequence
  Synthetic oligonucleotide
guuugugaauagaaguaaaaauaaa

SEQ ID NO: 382 - DNA, 25 bp, Artificial Sequence
  Synthetic oligonucleotide
gugaauagaaguaaaaauaaauacg

SEQ ID NO: 383 - DNA, 25 bp, Artificial Sequence
  Synthetic oligonucleotide
aagagguaaauauauuacuauuuca

SEQ ID NO: 384 - DNA, 25 bp, Artificial Sequence
  Synthetic oligonucleotide
agaaaugcauuuuuauacaaaaaaa

SEQ ID NO: 385 - RNA, 27 nt, Artificial Sequence
  Synthetic oligonucleotide
guuccuaucacauuggaauacauggcc

SEQ ID NO: 386 - RNA, 27 nt, Artificial Sequence
  Synthetic oligonucleotide
aguuccuaucacauuggaauacauggc

SEQ ID NO: 387 - RNA, 27 nt, Artificial Sequence
  Synthetic oligonucleotide
caguuccuaucacauuggaauacaugg

SEQ ID NO: 388 - RNA, 27 nt, Artificial Sequence
  Synthetic oligonucleotide
acaguuccuaucacauuggaauacaug

SEQ ID NO: 389 - RNA, 27 nt, Artificial Sequence
  Synthetic oligonucleotide
uacaguuccuaucacauuggaauacau

SEQ ID NO: 390 - RNA, 27 nt, Artificial Sequence
  Synthetic oligonucleotide
uuacaguuccuaucacauuggaauaca

SEQ ID NO: 391 - RNA, 27 nt, Artificial Sequence
  Synthetic oligonucleotide
guuacaguuccuaucacauuggaauac

SEQ ID NO: 392 - RNA, 27 nt, Artificial Sequence
  Synthetic oligonucleotide
aagauaaaccuuccuuuuuccagaggu

SEQ ID NO: 393 - RNA, 27 nt, Artificial Sequence
  Synthetic oligonucleotide
aaagauaaaccuuccuuuuuccagagg

SEQ ID NO: 394 - RNA, 27 nt, Artificial Sequence
  Synthetic oligonucleotide
aaaagauaaaccuuccuuuuuccagag

SEQ ID NO: 395 - RNA, 27 nt, Artificial Sequence
  Synthetic oligonucleotide
acaaaagauaaaccuuccuuuuuccag

SEQ ID NO: 396 - RNA, 27 nt, Artificial Sequence
  Synthetic oligonucleotide
gacaaaagauaaaccuuccuuuuucca

SEQ ID NO: 397 - RNA, 27 nt, Artificial Sequence
  Synthetic oligonucleotide
ggacaaaagauaaaccuuccuuuuucc

SEQ ID NO: 398 - RNA, 27 nt, Artificial Sequence
  Synthetic oligonucleotide
guaaaugcacaugggauucaugggaau

SEQ ID NO: 399 - RNA, 27 nt, Artificial Sequence
  Synthetic oligonucleotide
gguaaaugcacaugggauucaugggaa

SEQ ID NO: 400 - RNA, 27 nt, Artificial Sequence
  Synthetic oligonucleotide
agcgguaaaugcacaugggauucaugg

SEQ ID NO: 401 - RNA, 27 nt, Artificial Sequence
  Synthetic oligonucleotide
uucuccggggagcgguaaaugcacaug

SEQ ID NO: 402 - RNA, 27 nt, Artificial Sequence
  Synthetic oligonucleotide
aauuggccuuggacaguucccagacac

SEQ ID NO: 403 - RNA, 27 nt, Artificial Sequence
  Synthetic oligonucleotide
gaauuggccuuggacaguucccagaca

SEQ ID NO: 404 - RNA, 27 nt, Artificial Sequence
  Synthetic oligonucleotide
ggaauuggccuuggacaguucccagac

SEQ ID NO: 405 - RNA, 27 nt, Artificial Sequence
  Synthetic oligonucleotide
gggaauuggccuuggacaguucccaga

SEQ ID NO: 406 - RNA, 27 nt, Artificial Sequence
  Synthetic oligonucleotide
cgggaauuggccuuggacaguucccag

SEQ ID NO: 407 - RNA, 27 nt, Artificial Sequence
  Synthetic oligonucleotide
gcgggaauuggccuuggacaguuccca

SEQ ID NO: 408 - RNA, 27 nt, Artificial Sequence
  Synthetic oligonucleotide
agcgggaauuggccuuggacaguuccc

SEQ ID NO: 409 - RNA, 27 nt, Artificial Sequence
  Synthetic oligonucleotide
aagcgggaauuggccuuggacaguucc

SEQ ID NO: 410 - RNA, 27 nt, Artificial Sequence
  Synthetic oligonucleotide
uagaaagugguagcaaagcgggaauug

SEQ ID NO: 411 - RNA, 27 nt, Artificial Sequence
  Synthetic oligonucleotide
ugauagaaagugguagcaaagcgggaa

SEQ ID NO: 412 - RNA, 27 nt, Artificial Sequence
  Synthetic oligonucleotide
cugauagaaagugguagcaaagcggga

SEQ ID NO: 413 - RNA, 27 nt, Artificial Sequence
  Synthetic oligonucleotide
gcugauagaaagugguagcaaagcggg

SEQ ID NO: 414 - RNA, 27 nt, Artificial Sequence
  Synthetic oligonucleotide
ugcugauagaaagugguagcaaagcgg

SEQ ID NO: 415 - RNA, 27 nt, Artificial Sequence
  Synthetic oligonucleotide
gugcugauagaaagugguagcaaagcg

SEQ ID NO: 416 - RNA, 27 nt, Artificial Sequence
  Synthetic oligonucleotide
ggugcugauagaaagugguagcaaagc

SEQ ID NO: 417 - RNA, 27 nt, Artificial Sequence
  Synthetic oligonucleotide
aggugcugauagaaagugguagcaaag

SEQ ID NO: 418 - RNA, 27 nt, Artificial Sequence
  Synthetic oligonucleotide
caggugcugauagaaagugguagcaaa

SEQ ID NO: 419 - RNA, 27 nt, Artificial Sequence
  Synthetic oligonucleotide
ccaggugcugauagaaagugguagcaa

SEQ ID NO: 420 - RNA, 27 nt, Artificial Sequence
  Synthetic oligonucleotide
uugucauucuuggaaucugccaggugc

SEQ ID NO: 421 - RNA, 27 nt, Artificial Sequence
  Synthetic oligonucleotide
ucaggggugacaggaaaauguuaucau

SEQ ID NO: 422 - RNA, 27 nt, Artificial Sequence
  Synthetic oligonucleotide
uacucaggggugacaggaaaauguuau

SEQ ID NO: 423 - RNA, 27 nt, Artificial Sequence
  Synthetic oligonucleotide
gauacucaggggugacaggaaaauguu

SEQ ID NO: 424 - RNA, 27 nt, Artificial Sequence
  Synthetic oligonucleotide
cacccagcuuggucauagcaaaagccg

SEQ ID NO: 425 - RNA, 27 nt, Artificial Sequence
  Synthetic oligonucleotide
gcacccagcuuggucauagcaaaagcc

SEQ ID NO: 426 - RNA, 27 nt, Artificial Sequence
  Synthetic oligonucleotide
ggcacccagcuuggucauagcaaaagc

SEQ ID NO: 427 - RNA, 27 nt, Artificial Sequence
  Synthetic oligonucleotide
aggcacccagcuuggucauagcaaaag

SEQ ID NO: 428 - RNA, 27 nt, Artificial Sequence
  Synthetic oligonucleotide
caggcacccagcuuggucauagcaaaa

SEQ ID NO: 429 - RNA, 27 nt, Artificial Sequence
  Synthetic oligonucleotide
acaggcacccagcuuggucauagcaaa

SEQ ID NO: 430 - RNA, 27 nt, Artificial Sequence
  Synthetic oligonucleotide
uacaggcacccagcuuggucauagcaa

SEQ ID NO: 431 - RNA, 27 nt, Artificial Sequence
  Synthetic oligonucleotide
uuacaggcacccagcuuggucauagca

SEQ ID NO: 432 - RNA, 27 nt, Artificial Sequence
  Synthetic oligonucleotide
auuacaggcacccagcuuggucauagc

SEQ ID NO: 433 - RNA, 27 nt, Artificial Sequence
  Synthetic oligonucleotide
cauuacaggcacccagcuuggucauag

SEQ ID NO: 434 - RNA, 27 nt, Artificial Sequence
  Synthetic oligonucleotide
ucauuacaggcacccagcuuggucaua

SEQ ID NO: 435 - RNA, 27 nt, Artificial Sequence
  Synthetic oligonucleotide
gucauuacaggcacccagcuuggucau

SEQ ID NO: 436 - RNA, 27 nt, Artificial Sequence
  Synthetic oligonucleotide
ugucauuacaggcacccagcuugguca

SEQ ID NO: 437 - RNA, 27 nt, Artificial Sequence
  Synthetic oligonucleotide
gugucauuacaggcacccagcuugguc

SEQ ID NO: 438 - RNA, 27 nt, Artificial Sequence
  Synthetic oligonucleotide
aacuuaaauaccuccaucaguugcugg

SEQ ID NO: 439 - RNA, 27 nt, Artificial Sequence
  Synthetic oligonucleotide
aaacuuaaauaccuccaucaguugcug

SEQ ID NO: 440 - RNA, 27 nt, Artificial Sequence
  Synthetic oligonucleotide
caaacuuaaauaccuccaucaguugcu

SEQ ID NO: 441 - RNA, 27 nt, Artificial Sequence
  Synthetic oligonucleotide
ucaaacuuaaauaccuccaucaguugc

SEQ ID NO: 442 - RNA, 27 nt, Artificial Sequence
  Synthetic oligonucleotide
gucaaacuuaaauaccuccaucaguug

SEQ ID NO: 443 - RNA, 27 nt, Artificial Sequence
  Synthetic oligonucleotide
ugucaaacuuaaauaccuccaucaguu

SEQ ID NO: 444 - RNA, 27 nt, Artificial Sequence
  Synthetic oligonucleotide
gugucaaacuuaaauaccuccaucagu

SEQ ID NO: 445 - RNA, 27 nt, Artificial Sequence
  Synthetic oligonucleotide
ggugucaaacuuaaauaccuccaucag

SEQ ID NO: 446 - RNA, 27 nt, Artificial Sequence
  Synthetic oligonucleotide
uggugucaaacuuaaauaccuccauca

SEQ ID NO: 447 - RNA, 27 nt, Artificial Sequence
  Synthetic oligonucleotide
auggugucaaacuuaaauaccuccauc

SEQ ID NO: 448 - RNA, 27 nt, Artificial Sequence
  Synthetic oligonucleotide
uauggugucaaacuuaaauaccuccau

SEQ ID NO: 449 - RNA, 27 nt, Artificial Sequence
  Synthetic oligonucleotide
auauggugucaaacuuaaauaccucca

SEQ ID NO: 450 - RNA, 27 nt, Artificial Sequence
  Synthetic oligonucleotide
gauauggugucaaacuuaaauaccucc

SEQ ID NO: 451 - RNA, 27 nt, Artificial Sequence
  Synthetic oligonucleotide
agauauggugucaaacuuaaauaccuc

SEQ ID NO: 452 - RNA, 27 nt, Artificial Sequence
  Synthetic oligonucleotide
cagauauggugucaaacuuaaauaccu

SEQ ID NO: 453 - RNA, 27 nt, Artificial Sequence
  Synthetic oligonucleotide
ucagauauggugucaaacuuaaauacc

SEQ ID NO: 454 - RNA, 27 nt, Artificial Sequence
  Synthetic oligonucleotide
cucagauauggugucaaacuuaaauac

SEQ ID NO: 455 - RNA, 27 nt, Artificial Sequence
  Synthetic oligonucleotide
ucucagauauggugucaaacuuaaaua

SEQ ID NO: 456 - RNA, 27 nt, Artificial Sequence
  Synthetic oligonucleotide
uucucagauauggugucaaacuuaaau

SEQ ID NO: 457 - RNA, 27 nt, Artificial Sequence
  Synthetic oligonucleotide
uuucucagauauggugucaaacuuaaa

SEQ ID NO: 458 - RNA, 27 nt, Artificial Sequence
  Synthetic oligonucleotide
uuuucucagauauggugucaaacuuaa

SEQ ID NO: 459 - RNA, 27 nt, Artificial Sequence
  Synthetic oligonucleotide
guuuucucagauauggugucaaacuua

SEQ ID NO: 460 - RNA, 27 nt, Artificial Sequence
  Synthetic oligonucleotide
uguuuucucagauauggugucaaacuu

SEQ ID NO: 461 - RNA, 27 nt, Artificial Sequence
  Synthetic oligonucleotide
auguuuucucagauauggugucaaacu

SEQ ID NO: 462 - RNA, 27 nt, Artificial Sequence
  Synthetic oligonucleotide
gauguuuucucagauauggugucaaac

SEQ ID NO: 463 - RNA, 27 nt, Artificial Sequence
  Synthetic oligonucleotide
agauguuuucucagauauggugucaaa

SEQ ID NO: 464 - RNA, 27 nt, Artificial Sequence
  Synthetic oligonucleotide
cagauguuuucucagauauggugucaa

SEQ ID NO: 465 - RNA, 27 nt, Artificial Sequence
  Synthetic oligonucleotide
ucagauguuuucucagauaugguguca

SEQ ID NO: 466 - RNA, 27 nt, Artificial Sequence
  Synthetic oligonucleotide
aucagauguuuucucagauaugguguc

SEQ ID NO: 467 - RNA, 27 nt, Artificial Sequence
  Synthetic oligonucleotide
gaucagauguuuucucagauauggugu

SEQ ID NO: 468 - RNA, 27 nt, Artificial Sequence
  Synthetic oligonucleotide
ugaucagauguuuucucagauauggug

SEQ ID NO: 469 - RNA, 27 nt, Artificial Sequence
  Synthetic oligonucleotide
cugaucagauguuuucucagauauggu

SEQ ID NO: 470 - RNA, 27 nt, Artificial Sequence
  Synthetic oligonucleotide
ucugaucagauguuuucucagauaugg

SEQ ID NO: 471 - RNA, 27 nt, Artificial Sequence
  Synthetic oligonucleotide
aucugaucagauguuuucucagauaug

SEQ ID NO: 472 - RNA, 27 nt, Artificial Sequence
  Synthetic oligonucleotide
uggaucugaucagauguuuucucagau

SEQ ID NO: 473 - RNA, 27 nt, Artificial Sequence
  Synthetic oligonucleotide
guggaucugaucagauguuuucucaga

SEQ ID NO: 474 - RNA, 27 nt, Artificial Sequence
  Synthetic oligonucleotide
aguggaucugaucagauguuuucucag

SEQ ID NO: 475 - RNA, 27 nt, Artificial Sequence
  Synthetic oligonucleotide
aaguggaucugaucagauguuuucuca

SEQ ID NO: 476 - RNA, 27 nt, Artificial Sequence
  Synthetic oligonucleotide
uuggcaaagaagaaguggaucugauca

SEQ ID NO: 477 - RNA, 27 nt, Artificial Sequence
  Synthetic oligonucleotide
guuuggcaaagaagaaguggaucugau

SEQ ID NO: 478 - RNA, 27 nt, Artificial Sequence
  Synthetic oligonucleotide
aguuuggcaaagaagaaguggaucuga

SEQ ID NO: 479 - RNA, 27 nt, Artificial Sequence
  Synthetic oligonucleotide
caguuuggcaaagaagaaguggaucug

SEQ ID NO: 480 - RNA, 27 nt, Artificial Sequence
  Synthetic oligonucleotide
ucaguuuggcaaagaagaaguggaucu

SEQ ID NO: 481 - RNA, 27 nt, Artificial Sequence
  Synthetic oligonucleotide
uucaguuuggcaaagaagaaguggauc

SEQ ID NO: 482 - RNA, 27 nt, Artificial Sequence
  Synthetic oligonucleotide
guucaguuuggcaaagaagaaguggau

SEQ ID NO: 483 - RNA, 27 nt, Artificial Sequence
  Synthetic oligonucleotide
aguucaguuuggcaaagaagaagugga

SEQ ID NO: 484 - RNA, 27 nt, Artificial Sequence
  Synthetic oligonucleotide
caguucaguuuggcaaagaagaagugg

SEQ ID NO: 485 - RNA, 27 nt, Artificial Sequence
  Synthetic oligonucleotide
gcaguucaguuuggcaaagaagaagug

SEQ ID NO: 486 - RNA, 27 nt, Artificial Sequence
  Synthetic oligonucleotide
ggcaguucaguuuggcaaagaagaagu

SEQ ID NO: 487 - RNA, 27 nt, Artificial Sequence
  Synthetic oligonucleotide
cggcaguucaguuuggcaaagaagaag

SEQ ID NO: 488 - RNA, 27 nt, Artificial Sequence
  Synthetic oligonucleotide
ucggcaguucaguuuggcaaagaagaa

SEQ ID NO: 489 - RNA, 27 nt, Artificial Sequence
  Synthetic oligonucleotide
gucggcaguucaguuuggcaaagaaga

SEQ ID NO: 490 - RNA, 27 nt, Artificial Sequence
  Synthetic oligonucleotide
agucggcaguucaguuuggcaaagaag

SEQ ID NO: 491 - RNA, 27 nt, Artificial Sequence
  Synthetic oligonucleotide
gagucggcaguucaguuuggcaaagaa

SEQ ID NO: 492 - RNA, 27 nt, Artificial Sequence
  Synthetic oligonucleotide
agagucggcaguucaguuuggcaaaga

SEQ ID NO: 493 - RNA, 27 nt, Artificial Sequence
  Synthetic oligonucleotide
uagagucggcaguucaguuuggcaaag

SEQ ID NO: 494 - RNA, 27 nt, Artificial Sequence
  Synthetic oligonucleotide
auagagucggcaguucaguuuggcaaa

SEQ ID NO: 495 - RNA, 27 nt, Artificial Sequence
  Synthetic oligonucleotide
gauagagucggcaguucaguuuggcaa

SEQ ID NO: 496 - RNA, 27 nt, Artificial Sequence
  Synthetic oligonucleotide
cgauagagucggcaguucaguuuggca

SEQ ID NO: 497 - RNA, 27 nt, Artificial Sequence
  Synthetic oligonucleotide
ucgauagagucggcaguucaguuuggc

SEQ ID NO: 498 - RNA, 27 nt, Artificial Sequence
  Synthetic oligonucleotide
uucgauagagucggcaguucaguuugg

SEQ ID NO: 499 - RNA, 27 nt, Artificial Sequence
  Synthetic oligonucleotide
uuucgauagagucggcaguucaguuug

SEQ ID NO: 500 - RNA, 27 nt, Artificial Sequence
  Synthetic oligonucleotide
uuuucgauagagucggcaguucaguuu

SEQ ID NO: 501 - RNA, 27 nt, Artificial Sequence
  Synthetic oligonucleotide
cuuuucgauagagucggcaguucaguu

SEQ ID NO: 502 - RNA, 27 nt, Artificial Sequence
  Synthetic oligonucleotide
gcuuuucgauagagucggcaguucagu

SEQ ID NO: 503 - RNA, 27 nt, Artificial Sequence
  Synthetic oligonucleotide
ggcuuuucgauagagucggcaguucag

SEQ ID NO: 504 - RNA, 27 nt, Artificial Sequence
  Synthetic oligonucleotide
uggcuuuucgauagagucggcaguuca

SEQ ID NO: 505 - RNA, 27 nt, Artificial Sequence
  Synthetic oligonucleotide
uuggcuuuucgauagagucggcaguuc

SEQ ID NO: 506 - RNA, 27 nt, Artificial Sequence
  Synthetic oligonucleotide
guuggcuuuucgauagagucggcaguu

SEQ ID NO: 507 - RNA, 27 nt, Artificial Sequence
  Synthetic oligonucleotide
uguuggcuuuucgauagagucggcagu

SEQ ID NO: 508 - RNA, 27 nt, Artificial Sequence
  Synthetic oligonucleotide
uuguuggcuuuucgauagagucggcag

SEQ ID NO: 509 - RNA, 27 nt, Artificial Sequence
  Synthetic oligonucleotide
uuuguuggcuuuucgauagagucggca

SEQ ID NO: 510 - RNA, 27 nt, Artificial Sequence
  Synthetic oligonucleotide
auuuguuggcuuuucgauagagucggc

SEQ ID NO: 511 - RNA, 27 nt, Artificial Sequence
  Synthetic oligonucleotide
gauuuguuggcuuuucgauagagucgg

SEQ ID NO: 512 - RNA, 27 nt, Artificial Sequence
  Synthetic oligonucleotide
ggauuuguuggcuuuucgauagagucg

SEQ ID NO: 513 - RNA, 27 nt, Artificial Sequence
  Synthetic oligonucleotide
aggauuuguuggcuuuucgauagaguc

SEQ ID NO: 514 - RNA, 27 nt, Artificial Sequence
  Synthetic oligonucleotide
gaggauuuguuggcuuuucgauagagu

SEQ ID NO: 515 - RNA, 27 nt, Artificial Sequence
  Synthetic oligonucleotide
uaacuuggaggauuuguuggcuuuucg

SEQ ID NO: 516 - RNA, 27 nt, Artificial Sequence
  Synthetic oligonucleotide
cuaacuuggaggauuuguuggcuuuuc

SEQ ID NO: 517 - RNA, 27 nt, Artificial Sequence
  Synthetic oligonucleotide
auacuaacuuggaggauuuguuggcuu

SEQ ID NO: 518 - RNA, 27 nt, Artificial Sequence
  Synthetic oligonucleotide
gauacuaacuuggaggauuuguuggcu

SEQ ID NO: 519 - RNA, 27 nt, Artificial Sequence
  Synthetic oligonucleotide
ugauacuaacuuggaggauuuguuggc

SEQ ID NO: 520 - RNA, 27 nt, Artificial Sequence
  Synthetic oligonucleotide
cugauacuaacuuggaggauuuguugg

SEQ ID NO: 521 - RNA, 27 nt, Artificial Sequence
  Synthetic oligonucleotide
gcugauacuaacuuggaggauuuguug

SEQ ID NO: 522 - RNA, 27 nt, Artificial Sequence
  Synthetic oligonucleotide
ggcugauacuaacuuggaggauuuguu

SEQ ID NO: 523 - RNA, 27 nt, Artificial Sequence
  Synthetic oligonucleotide
aaaaggcgauuggcugauacuaacuug

SEQ ID NO: 524 - RNA, 27 nt, Artificial Sequence
  Synthetic oligonucleotide
uccaaaaaggcgauuggcugauacuaa

SEQ ID NO: 525 - RNA, 27 nt, Artificial Sequence
  Synthetic oligonucleotide
uugucuccaaaaaggcgauuggcugau

SEQ ID NO: 526 - RNA, 27 nt, Artificial Sequence
  Synthetic oligonucleotide
uuugucuccaaaaaggcgauuggcuga

SEQ ID NO: 527 - RNA, 27 nt, Artificial Sequence
  Synthetic oligonucleotide
auuugucuccaaaaaggcgauuggcug

SEQ ID NO: 528 - RNA, 27 nt, Artificial Sequence
  Synthetic oligonucleotide
agggauuugucuccaaaaaggcgauug

SEQ ID NO: 529 - RNA, 27 nt, Artificial Sequence
  Synthetic oligonucleotide
uaagggauuugucuccaaaaaggcgau

SEQ ID NO: 530 - RNA, 27 nt, Artificial Sequence
  Synthetic oligonucleotide
guaagggauuugucuccaaaaaggcga

SEQ ID NO: 531 - RNA, 27 nt, Artificial Sequence
  Synthetic oligonucleotide
gguaagggauuugucuccaaaaaggcg

SEQ ID NO: 532 - RNA, 27 nt, Artificial Sequence
  Synthetic oligonucleotide
agguaagggauuugucuccaaaaaggc

SEQ ID NO: 533 - RNA, 27 nt, Artificial Sequence
  Synthetic oligonucleotide
aagguaagggauuugucuccaaaaagg

SEQ ID NO: 534 - RNA, 27 nt, Artificial Sequence
  Synthetic oligonucleotide
auugaagguaagggauuugucuccaaa

SEQ ID NO: 535 - RNA, 27 nt, Artificial Sequence
  Synthetic oligonucleotide
cauugaagguaagggauuugucuccaa

SEQ ID NO: 536 - RNA, 27 nt, Artificial Sequence
  Synthetic oligonucleotide
ucauugaagguaagggauuugucucca

SEQ ID NO: 537 - RNA, 27 nt, Artificial Sequence
  Synthetic oligonucleotide
cucauugaagguaagggauuugucucc

SEQ ID NO: 538 - RNA, 27 nt, Artificial Sequence
  Synthetic oligonucleotide
ucucauugaagguaagggauuugucuc

SEQ ID NO: 539 - RNA, 27 nt, Artificial Sequence
  Synthetic oligonucleotide
gucucauugaagguaagggauuugucu

SEQ ID NO: 540 - RNA, 27 nt, Artificial Sequence
  Synthetic oligonucleotide
aggucucauugaagguaagggauuugu

SEQ ID NO: 541 - RNA, 27 nt, Artificial Sequence
  Synthetic oligonucleotide
uaggucucauugaagguaagggauuug

SEQ ID NO: 542 - RNA, 27 nt, Artificial Sequence
  Synthetic oligonucleotide
guaggucucauugaagguaagggauuu

SEQ ID NO: 543 - RNA, 27 nt, Artificial Sequence
  Synthetic oligonucleotide
uguccugguaggucucauugaagguaa

SEQ ID NO: 544 - RNA, 27 nt, Artificial Sequence
  Synthetic oligonucleotide
cugauguccugguaggucucauugaag

SEQ ID NO: 545 - RNA, 27 nt, Artificial Sequence
  Synthetic oligonucleotide
acugauguccugguaggucucauugaa

SEQ ID NO: 546 - RNA, 27 nt, Artificial Sequence
  Synthetic oligonucleotide
cacugauguccugguaggucucauuga

SEQ ID NO: 547 - RNA, 27 nt, Artificial Sequence
  Synthetic oligonucleotide
cucacugauguccugguaggucucauu

SEQ ID NO: 548 - RNA, 27 nt, Artificial Sequence
  Synthetic oligonucleotide
aacucacugauguccugguaggucuca

SEQ ID NO: 549 - RNA, 27 nt, Artificial Sequence
  Synthetic oligonucleotide
uaccaacucacugauguccugguaggu

SEQ ID NO: 550 - RNA, 27 nt, Artificial Sequence
  Synthetic oligonucleotide
auaccaacucacugauguccugguagg

SEQ ID NO: 551 - RNA, 27 nt, Artificial Sequence
  Synthetic oligonucleotide
uauaccaacucacugauguccugguag

SEQ ID NO: 552 - RNA, 27 nt, Artificial Sequence
  Synthetic oligonucleotide
auauaccaacucacugauguccuggua

SEQ ID NO: 553 - RNA, 27 nt, Artificial Sequence
  Synthetic oligonucleotide
cauauaccaacucacugauguccuggu

SEQ ID NO: 554 - RNA, 27 nt, Artificial Sequence
  Synthetic oligonucleotide
ccauauaccaacucacugauguccugg

SEQ ID NO: 555 - RNA, 27 nt, Artificial Sequence
  Synthetic oligonucleotide
uccauauaccaacucacugauguccug

SEQ ID NO: 556 - RNA, 27 nt, Artificial Sequence
  Synthetic oligonucleotide
cuccauauaccaacucacugauguccu

SEQ ID NO: 557 - RNA, 27 nt, Artificial Sequence
  Synthetic oligonucleotide
gcuccauauaccaacucacugaugucc

SEQ ID NO: 558 - RNA, 27 nt, Artificial Sequence
  Synthetic oligonucleotide
ccaggggcuggagcuuggcuccauaua

SEQ ID NO: 559 - RNA, 27 nt, Artificial Sequence
  Synthetic oligonucleotide
uccaggggcuggagcuuggcuccauau

SEQ ID NO: 560 - RNA, 27 nt, Artificial Sequence
  Synthetic oligonucleotide
guccaggggcuggagcuuggcuccaua

SEQ ID NO: 561 - RNA, 27 nt, Artificial Sequence
  Synthetic oligonucleotide
aguccaggggcuggagcuuggcuccau

SEQ ID NO: 562 - RNA, 27 nt, Artificial Sequence
  Synthetic oligonucleotide
aaguccaggggcuggagcuuggcucca

SEQ ID NO: 563 - RNA, 27 nt, Artificial Sequence
  Synthetic oligonucleotide
gaaguccaggggcuggagcuuggcucc

SEQ ID NO: 564 - RNA, 27 nt, Artificial Sequence
  Synthetic oligonucleotide
ugaaguccaggggcuggagcuuggcuc

SEQ ID NO: 565 - RNA, 27 nt, Artificial Sequence
  Synthetic oligonucleotide
uugaaguccaggggcuggagcuuggcu

SEQ ID NO: 566 - RNA, 27 nt, Artificial Sequence
  Synthetic oligonucleotide
cuugaaguccaggggcuggagcuuggc

SEQ ID NO: 567 - RNA, 27 nt, Artificial Sequence
  Synthetic oligonucleotide
ccuugaaguccaggggcuggagcuugg

SEQ ID NO: 568 - RNA, 27 nt, Artificial Sequence
  Synthetic oligonucleotide
uccuugaaguccaggggcuggagcuug

SEQ ID NO: 569 - RNA, 27 nt, Artificial Sequence
  Synthetic oligonucleotide
uuccuugaaguccaggggcuggagcuu

SEQ ID NO: 570 - RNA, 27 nt, Artificial Sequence
  Synthetic oligonucleotide
uuuccuugaaguccaggggcuggagcu

SEQ ID NO: 571 - RNA, 27 nt, Artificial Sequence
  Synthetic oligonucleotide
uuuuccuugaaguccaggggcuggagc

SEQ ID NO: 572 - RNA, 27 nt, Artificial Sequence
  Synthetic oligonucleotide
auuuuccuugaaguccaggggcuggag

SEQ ID NO: 573 - RNA, 27 nt, Artificial Sequence
  Synthetic oligonucleotide
cauuuuccuugaaguccaggggcugga

SEQ ID NO: 574 - RNA, 27 nt, Artificial Sequence
  Synthetic oligonucleotide
gcauuuuccuugaaguccaggggcugg

SEQ ID NO: 575 - RNA, 27 nt, Artificial Sequence
  Synthetic oligonucleotide
ugcauuuuccuugaaguccaggggcug

SEQ ID NO: 576 - RNA, 27 nt, Artificial Sequence
  Synthetic oligonucleotide
ugcucugcauuuuccuugaaguccagg

SEQ ID NO: 577 - RNA, 27 nt, Artificial Sequence
  Synthetic oligonucleotide
uugcucugcauuuuccuugaaguccag

SEQ ID NO: 578 - RNA, 27 nt, Artificial Sequence
  Synthetic oligonucleotide
auugcucugcauuuuccuugaagucca

SEQ ID NO: 579 - RNA, 27 nt, Artificial Sequence
  Synthetic oligonucleotide
gauugcucugcauuuuccuugaagucc

SEQ ID NO: 580 - RNA, 27 nt, Artificial Sequence
  Synthetic oligonucleotide
uggauugcucugcauuuuccuugaagu

SEQ ID NO: 581 - RNA, 27 nt, Artificial Sequence
  Synthetic oligonucleotide
cuggauugcucugcauuuuccuugaag

SEQ ID NO: 582 - RNA, 27 nt, Artificial Sequence
  Synthetic oligonucleotide
ucuggauugcucugcauuuuccuugaa

SEQ ID NO: 583 - RNA, 27 nt, Artificial Sequence
  Synthetic oligonucleotide
cucuggauugcucugcauuuuccuuga

SEQ ID NO: 584 - RNA, 27 nt, Artificial Sequence
  Synthetic oligonucleotide
cuuauuggacacccauuuguugauggc

SEQ ID NO: 585 - RNA, 27 nt, Artificial Sequence
  Synthetic oligonucleotide
ucuuauuggacacccauuuguugaugg

SEQ ID NO: 586 - RNA, 27 nt, Artificial Sequence
  Synthetic oligonucleotide
uucggucuuauuggacacccauuuguu

SEQ ID NO: 587 - RNA, 27 nt, Artificial Sequence
  Synthetic oligonucleotide
uaaccagcaccagaacagugagcucau

SEQ ID NO: 588 - RNA, 27 nt, Artificial Sequence
  Synthetic oligonucleotide
guuaaccagcaccagaacagugagcuc

SEQ ID NO: 589 - RNA, 27 nt, Artificial Sequence
  Synthetic oligonucleotide
uguuaaccagcaccagaacagugagcu

SEQ ID NO: 590 - RNA, 27 nt, Artificial Sequence
  Synthetic oligonucleotide
guguuaaccagcaccagaacagugagc

SEQ ID NO: 591 - RNA, 27 nt, Artificial Sequence
  Synthetic oligonucleotide
gguguuaaccagcaccagaacagugag

SEQ ID NO: 592 - RNA, 27 nt, Artificial Sequence
  Synthetic oligonucleotide
ugguguuaaccagcaccagaacaguga

SEQ ID NO: 593 - RNA, 27 nt, Artificial Sequence
  Synthetic oligonucleotide
augguguuaaccagcaccagaacagug

SEQ ID NO: 594 - RNA, 27 nt, Artificial Sequence
  Synthetic oligonucleotide
aaugguguuaaccagcaccagaacagu

SEQ ID NO: 595 - RNA, 27 nt, Artificial Sequence
  Synthetic oligonucleotide
aaaugguguuaaccagcaccagaacag

SEQ ID NO: 596 - RNA, 27 nt, Artificial Sequence
  Synthetic oligonucleotide
uaaaugguguuaaccagcaccagaaca

SEQ ID NO: 597 - RNA, 27 nt, Artificial Sequence
  Synthetic oligonucleotide
guaaaugguguuaaccagcaccagaac

SEQ ID NO: 598 - RNA, 27 nt, Artificial Sequence
  Synthetic oligonucleotide
aguaaaugguguuaaccagcaccagaa

SEQ ID NO: 599 - RNA, 27 nt, Artificial Sequence
  Synthetic oligonucleotide
aaguaaaugguguuaaccagcaccaga

SEQ ID NO: 600 - RNA, 27 nt, Artificial Sequence
  Synthetic oligonucleotide
gaaguaaaugguguuaaccagcaccag

SEQ ID NO: 601 - RNA, 27 nt, Artificial Sequence
  Synthetic oligonucleotide
ugaaguaaaugguguuaaccagcacca

SEQ ID NO: 602 - RNA, 27 nt, Artificial Sequence
  Synthetic oligonucleotide
uugaaguaaaugguguuaaccagcacc

SEQ ID NO: 603 - RNA, 27 nt, Artificial Sequence
  Synthetic oligonucleotide
cuugaaguaaaugguguuaaccagcac

SEQ ID NO: 604 - RNA, 27 nt, Artificial Sequence
  Synthetic oligonucleotide
ccuugaaguaaaugguguuaaccagca

SEQ ID NO: 605 - RNA, 27 nt, Artificial Sequence
  Synthetic oligonucleotide
cccuugaaguaaaugguguuaaccagc

SEQ ID NO: 606 - RNA, 27 nt, Artificial Sequence
  Synthetic oligonucleotide
gcccuugaaguaaaugguguuaaccag

SEQ ID NO: 607 - RNA, 27 nt, Artificial Sequence
  Synthetic oligonucleotide
ggcccuugaaguaaaugguguuaacca

SEQ ID NO: 608 - RNA, 27 nt, Artificial Sequence
  Synthetic oligonucleotide
aggcccuugaaguaaaugguguuaacc

SEQ ID NO: 609 - RNA, 27 nt, Artificial Sequence
  Synthetic oligonucleotide
caggcccuugaaguaaaugguguuaac

SEQ ID NO: 610 - RNA, 27 nt, Artificial Sequence
  Synthetic oligonucleotide
acaggcccuugaaguaaaugguguuaa

SEQ ID NO: 611 - RNA, 27 nt, Artificial Sequence
  Synthetic oligonucleotide
cacaggcccuugaaguaaaugguguua

SEQ ID NO: 612 - RNA, 27 nt, Artificial Sequence
  Synthetic oligonucleotide
ccacaggcccuugaaguaaaugguguu

SEQ ID NO: 613 - RNA, 27 nt, Artificial Sequence
  Synthetic oligonucleotide
uccacaggcccuugaaguaaauggugu

SEQ ID NO: 614 - RNA, 27 nt, Artificial Sequence
  Synthetic oligonucleotide
uuccacaggcccuugaaguaaauggug

SEQ ID NO: 615 - RNA, 27 nt, Artificial Sequence
  Synthetic oligonucleotide
cuuccacaggcccuugaaguaaauggu

SEQ ID NO: 616 - RNA, 27 nt, Artificial Sequence
  Synthetic oligonucleotide
acuuccacaggcccuugaaguaaaugg

SEQ ID NO: 617 - RNA, 27 nt, Artificial Sequence
  Synthetic oligonucleotide
gacuuccacaggcccuugaaguaaaug

SEQ ID NO: 618 - RNA, 27 nt, Artificial Sequence
  Synthetic oligonucleotide
ugacuuccacaggcccuugaaguaaau

SEQ ID NO: 619 - RNA, 27 nt, Artificial Sequence
  Synthetic oligonucleotide
uugacuuccacaggcccuugaaguaaa

SEQ ID NO: 620 - RNA, 27 nt, Artificial Sequence
  Synthetic oligonucleotide
uuugacuuccacaggcccuugaaguaa

SEQ ID NO: 621 - RNA, 27 nt, Artificial Sequence
  Synthetic oligonucleotide
cuuugacuuccacaggcccuugaagua

SEQ ID NO: 622 - RNA, 27 nt, Artificial Sequence
  Synthetic oligonucleotide
acuuugacuuccacaggcccuugaagu

SEQ ID NO: 623 - RNA, 27 nt, Artificial Sequence
  Synthetic oligonucleotide
aacuuugacuuccacaggcccuugaag

SEQ ID NO: 624 - RNA, 27 nt, Artificial Sequence
  Synthetic oligonucleotide
gaacuuugacuuccacaggcccuugaa

SEQ ID NO: 625 - RNA, 27 nt, Artificial Sequence
  Synthetic oligonucleotide
ugaacuuugacuuccacaggcccuuga

SEQ ID NO: 626 - RNA, 27 nt, Artificial Sequence
  Synthetic oligonucleotide
cugaacuuugacuuccacaggcccuug

SEQ ID NO: 627 - RNA, 27 nt, Artificial Sequence
  Synthetic oligonucleotide
gcugaacuuugacuuccacaggcccuu

SEQ ID NO: 628 - RNA, 27 nt, Artificial Sequence
  Synthetic oligonucleotide
ggcugaacuuugacuuccacaggcccu

SEQ ID NO: 629 - RNA, 27 nt, Artificial Sequence
  Synthetic oligonucleotide
gggcugaacuuugacuuccacaggccc

SEQ ID NO: 630 - RNA, 27 nt, Artificial Sequence
  Synthetic oligonucleotide
agggcugaacuuugacuuccacaggcc

SEQ ID NO: 631 - RNA, 27 nt, Artificial Sequence
  Synthetic oligonucleotide
cagggcugaacuuugacuuccacaggc

SEQ ID NO: 632 - RNA, 27 nt, Artificial Sequence
  Synthetic oligonucleotide
ucagggcugaacuuugacuuccacagg

SEQ ID NO: 633 - RNA, 27 nt, Artificial Sequence
  Synthetic oligonucleotide
cucagggcugaacuuugacuuccacag

SEQ ID NO: 634 - RNA, 27 nt, Artificial Sequence
  Synthetic oligonucleotide
ucucagggcugaacuuugacuuccaca

SEQ ID NO: 635 - RNA, 27 nt, Artificial Sequence
  Synthetic oligonucleotide
uucucagggcugaacuuugacuuccac

SEQ ID NO: 636 - RNA, 27 nt, Artificial Sequence
  Synthetic oligonucleotide
guucucagggcugaacuuugacuucca

SEQ ID NO: 637 - RNA, 27 nt, Artificial Sequence
  Synthetic oligonucleotide
uguucucagggcugaacuuugacuucc

SEQ ID NO: 638 - RNA, 27 nt, Artificial Sequence
  Synthetic oligonucleotide
guguucucagggcugaacuuugacuuc

SEQ ID NO: 639 - RNA, 27 nt, Artificial Sequence
  Synthetic oligonucleotide
ugaacacgacucuccaucagccuugua

SEQ ID NO: 640 - RNA, 27 nt, Artificial Sequence
  Synthetic oligonucleotide
uagaugcugaacacgacucuccaucag

SEQ ID NO: 641 - RNA, 27 nt, Artificial Sequence
  Synthetic oligonucleotide
auagaugcugaacacgacucuccauca

SEQ ID NO: 642 - RNA, 27 nt, Artificial Sequence
  Synthetic oligonucleotide
aacuugccuuccugguacaucauagau

SEQ ID NO: 643 - RNA, 27 nt, Artificial Sequence
  Synthetic oligonucleotide
gaacuugccuuccugguacaucauaga

SEQ ID NO: 644 - RNA, 27 nt, Artificial Sequence
  Synthetic oligonucleotide
ggaacuugccuuccugguacaucauag

SEQ ID NO: 645 - RNA, 27 nt, Artificial Sequence
  Synthetic oligonucleotide
cggaacuugccuuccugguacaucaua

SEQ ID NO: 646 - RNA, 27 nt, Artificial Sequence
  Synthetic oligonucleotide
aacggaacuugccuuccugguacauca

SEQ ID NO: 647 - RNA, 27 nt, Artificial Sequence
  Synthetic oligonucleotide
uuugaagggcaacucaagcaccugggu

SEQ ID NO: 648 - RNA, 27 nt, Artificial Sequence
  Synthetic oligonucleotide
accuuugaagggcaacucaagcaccug

SEQ ID NO: 649 - RNA, 27 nt, Artificial Sequence
  Synthetic oligonucleotide
caccuuugaagggcaacucaagcaccu

SEQ ID NO: 650 - RNA, 27 nt, Artificial Sequence
  Synthetic oligonucleotide
ucaccuuugaagggcaacucaagcacc

SEQ ID NO: 651 - RNA, 27 nt, Artificial Sequence
  Synthetic oligonucleotide
ugaggaccauggugaugucaucaccuu

SEQ ID NO: 652 - RNA, 27 nt, Artificial Sequence
  Synthetic oligonucleotide
augaggaccauggugaugucaucaccu

SEQ ID NO: 653 - RNA, 27 nt, Artificial Sequence
  Synthetic oligonucleotide
gccaggcucuucucaggcuugggcaag

SEQ ID NO: 654 - RNA, 27 nt, Artificial Sequence
  Synthetic oligonucleotide
ggccaggcucuucucaggcuugggcaa

SEQ ID NO: 655 - RNA, 27 nt, Artificial Sequence
  Synthetic oligonucleotide
uggccaggcucuucucaggcuugggca

SEQ ID NO: 656 - RNA, 27 nt, Artificial Sequence
  Synthetic oligonucleotide
uuggccaggcucuucucaggcuugggc

SEQ ID NO: 657 - RNA, 27 nt, Artificial Sequence
  Synthetic oligonucleotide
cuuggccaggcucuucucaggcuuggg

SEQ ID NO: 658 - RNA, 27 nt, Artificial Sequence
  Synthetic oligonucleotide
ccuuggccaggcucuucucaggcuugg

SEQ ID NO: 659 - RNA, 27 nt, Artificial Sequence
  Synthetic oligonucleotide
accuuggccaggcucuucucaggcuug

SEQ ID NO: 660 - RNA, 27 nt, Artificial Sequence
  Synthetic oligonucleotide
uaccuuggccaggcucuucucaggcuu

SEQ ID NO: 661 - RNA, 27 nt, Artificial Sequence
  Synthetic oligonucleotide
cuaccuuggccaggcucuucucaggcu

SEQ ID NO: 662 - RNA, 27 nt, Artificial Sequence
  Synthetic oligonucleotide
ucuaccuuggccaggcucuucucaggc

SEQ ID NO: 663 - RNA, 27 nt, Artificial Sequence
  Synthetic oligonucleotide
cucuaccuuggccaggcucuucucagg

SEQ ID NO: 664 - RNA, 27 nt, Artificial Sequence
  Synthetic oligonucleotide
ucucuaccuuggccaggcucuucucag

SEQ ID NO: 665 - RNA, 27 nt, Artificial Sequence
  Synthetic oligonucleotide
uucucuaccuuggccaggcucuucuca

SEQ ID NO: 666 - RNA, 27 nt, Artificial Sequence
  Synthetic oligonucleotide
ugcggaagcggggcauguggaccacca

SEQ ID NO: 667 - RNA, 27 nt, Artificial Sequence
  Synthetic oligonucleotide
augcggaagcggggcauguggaccacc

SEQ ID NO: 668 - RNA, 27 nt, Artificial Sequence
  Synthetic oligonucleotide
aaugcggaagcggggcauguggaccac

SEQ ID NO: 669 - RNA, 27 nt, Artificial Sequence
  Synthetic oligonucleotide
caaugcggaagcggggcauguggacca

SEQ ID NO: 670 - RNA, 27 nt, Artificial Sequence
  Synthetic oligonucleotide
ucaaugcggaagcggggcauguggacc

SEQ ID NO: 671 - RNA, 27 nt, Artificial Sequence
  Synthetic oligonucleotide
cucaaugcggaagcggggcauguggac

SEQ ID NO: 672 - RNA, 27 nt, Artificial Sequence
  Synthetic oligonucleotide
ccucaaugcggaagcggggcaugugga

SEQ ID NO: 673 - RNA, 27 nt, Artificial Sequence
  Synthetic oligonucleotide
ugucuugcagcugcuccuucaaacuga

SEQ ID NO: 674 - RNA, 27 nt, Artificial Sequence
  Synthetic oligonucleotide
augucuugcagcugcuccuucaaacug

SEQ ID NO: 675 - RNA, 27 nt, Artificial Sequence
  Synthetic oligonucleotide
cccaugucuugcagcugcuccuucaaa

SEQ ID NO: 676 - RNA, 27 nt, Artificial Sequence
  Synthetic oligonucleotide
gcccaugucuugcagcugcuccuucaa

SEQ ID NO: 677 - RNA, 27 nt, Artificial Sequence
  Synthetic oligonucleotide
ggcccaugucuugcagcugcuccuuca

SEQ ID NO: 678 - RNA, 27 nt, Artificial Sequence
  Synthetic oligonucleotide
aggcccaugucuugcagcugcuccuuc

SEQ ID NO: 679 - RNA, 27 nt, Artificial Sequence
  Synthetic oligonucleotide
aaggcccaugucuugcagcugcuccuu

SEQ ID NO: 680 - RNA, 27 nt, Artificial Sequence
  Synthetic oligonucleotide
caaggcccaugucuugcagcugcuccu

SEQ ID NO: 681 - RNA, 27 nt, Artificial Sequence
  Synthetic oligonucleotide
acaaggcccaugucuugcagcugcucc

SEQ ID NO: 682 - RNA, 27 nt, Artificial Sequence
  Synthetic oligonucleotide
gacaaggcccaugucuugcagcugcuc

SEQ ID NO: 683 - RNA, 27 nt, Artificial Sequence
  Synthetic oligonucleotide
cgacaaggcccaugucuugcagcugcu

SEQ ID NO: 684 - RNA, 27 nt, Artificial Sequence
  Synthetic oligonucleotide
ucgacaaggcccaugucuugcagcugc

SEQ ID NO: 685 - RNA, 27 nt, Artificial Sequence
  Synthetic oligonucleotide
uuuucagggcugaacagaucgacaagg

SEQ ID NO: 686 - RNA, 27 nt, Artificial Sequence
  Synthetic oligonucleotide
acuuuucagggcugaacagaucgacaa

SEQ ID NO: 687 - RNA, 27 nt, Artificial Sequence
  Synthetic oligonucleotide
gacuuuucagggcugaacagaucgaca

SEQ ID NO: 688 - RNA, 27 nt, Artificial Sequence
  Synthetic oligonucleotide
uggacuuuucagggcugaacagaucga

SEQ ID NO: 689 - RNA, 27 nt, Artificial Sequence
  Synthetic oligonucleotide
guuuggacuuuucagggcugaacagau

SEQ ID NO: 690 - RNA, 27 nt, Artificial Sequence
  Synthetic oligonucleotide
gaguuuggacuuuucagggcugaacag

SEQ ID NO: 691 - RNA, 27 nt, Artificial Sequence
  Synthetic oligonucleotide
aacaauaccugggaguuuggacuuuuc

SEQ ID NO: 692 - RNA, 27 nt, Artificial Sequence
  Synthetic oligonucleotide
caacaauaccugggaguuuggacuuuu

SEQ ID NO: 693 - RNA, 27 nt, Artificial Sequence
  Synthetic oligonucleotide
ugcaacaauaccugggaguuuggacuu

SEQ ID NO: 694 - RNA, 27 nt, Artificial Sequence
  Synthetic oligonucleotide
ucugcaacaauaccugggaguuuggac

SEQ ID NO: 695 - RNA, 27 nt, Artificial Sequence
  Synthetic oligonucleotide
uucugcaacaauaccugggaguuugga

SEQ ID NO: 696 - RNA, 27 nt, Artificial Sequence
  Synthetic oligonucleotide
cuucugcaacaauaccugggaguuugg

SEQ ID NO: 697 - RNA, 27 nt, Artificial Sequence
  Synthetic oligonucleotide
ccuucugcaacaauaccugggaguuug

SEQ ID NO: 698 - RNA, 27 nt, Artificial Sequence
  Synthetic oligonucleotide
cauuuaccucaagaaaugccuuaugga

SEQ ID NO: 699 - RNA, 27 nt, Artificial Sequence
  Synthetic oligonucleotide
ucauuuaccucaagaaaugccuuaugg

SEQ ID NO: 700 - RNA, 27 nt, Artificial Sequence
  Synthetic oligonucleotide
uucauuuaccucaagaaaugccuuaug

SEQ ID NO: 701 - RNA, 27 nt, Artificial Sequence
  Synthetic oligonucleotide
cuucauuuaccucaagaaaugccuuau

SEQ ID NO: 702 - RNA, 27 nt, Artificial Sequence
  Synthetic oligonucleotide
ucuucauuuaccucaagaaaugccuua

SEQ ID NO: 703 - RNA, 27 nt, Artificial Sequence
  Synthetic oligonucleotide
uucuucauuuaccucaagaaaugccuu

SEQ ID NO: 704 - RNA, 27 nt, Artificial Sequence
  Synthetic oligonucleotide
cuucuucauuuaccucaagaaaugccu

SEQ ID NO: 705 - RNA, 27 nt, Artificial Sequence
  Synthetic oligonucleotide
ccuucuucauuuaccucaagaaaugcc

SEQ ID NO: 706 - RNA, 27 nt, Artificial Sequence
  Synthetic oligonucleotide
uucacugccuucuucauuuaccucaag

SEQ ID NO: 707 - RNA, 27 nt, Artificial Sequence
  Synthetic oligonucleotide
cuucacugccuucuucauuuaccucaa

SEQ ID NO: 708 - RNA, 27 nt, Artificial Sequence
  Synthetic oligonucleotide
gcuucacugccuucuucauuuaccuca

SEQ ID NO: 709 - RNA, 27 nt, Artificial Sequence
  Synthetic oligonucleotide
ugcuucacugccuucuucauuuaccuc

SEQ ID NO: 710 - RNA, 27 nt, Artificial Sequence
  Synthetic oligonucleotide
cugcuucacugccuucuucauuuaccu

SEQ ID NO: 711 - RNA, 27 nt, Artificial Sequence
  Synthetic oligonucleotide
gcugcuucacugccuucuucauuuacc

SEQ ID NO: 712 - RNA, 27 nt, Artificial Sequence
  Synthetic oligonucleotide
agcugcuucacugccuucuucauuuac

SEQ ID NO: 713 - RNA, 27 nt, Artificial Sequence
  Synthetic oligonucleotide
cuugcagcugcuucacugccuucuuca

SEQ ID NO: 714 - RNA, 27 nt, Artificial Sequence
  Synthetic oligonucleotide
guacuugcagcugcuucacugccuucu

SEQ ID NO: 715 - RNA, 27 nt, Artificial Sequence
  Synthetic oligonucleotide
gguacuugcagcugcuucacugccuuc

SEQ ID NO: 716 - RNA, 27 nt, Artificial Sequence
  Synthetic oligonucleotide
acaacagcgguacuugcagcugcuuca

SEQ ID NO: 717 - RNA, 27 nt, Artificial Sequence
  Synthetic oligonucleotide
uuauaaaaaccaggaaaggccuguugg

SEQ ID NO: 718 - RNA, 27 nt, Artificial Sequence
  Synthetic oligonucleotide
cuuauaaaaaccaggaaaggccuguug

SEQ ID NO: 719 - RNA, 27 nt, Artificial Sequence
  Synthetic oligonucleotide
ucuuauaaaaaccaggaaaggccuguu

SEQ ID NO: 720 - RNA, 27 nt, Artificial Sequence
  Synthetic oligonucleotide
cucuuauaaaaaccaggaaaggccugu

SEQ ID NO: 721 - RNA, 27 nt, Artificial Sequence
  Synthetic oligonucleotide
ucucuuauaaaaaccaggaaaggccug

SEQ ID NO: 722 - RNA, 27 nt, Artificial Sequence
  Synthetic oligonucleotide
uucucuuauaaaaaccaggaaaggccu

SEQ ID NO: 723 - RNA, 27 nt, Artificial Sequence
  Synthetic oligonucleotide
acuucucuuauaaaaaccaggaaaggc

SEQ ID NO: 724 - RNA, 27 nt, Artificial Sequence
  Synthetic oligonucleotide
aacuucucuuauaaaaaccaggaaagg

SEQ ID NO: 725 - RNA, 27 nt, Artificial Sequence
  Synthetic oligonucleotide
gaacuucucuuauaaaaaccaggaaag

SEQ ID NO: 726 - RNA, 27 nt, Artificial Sequence
  Synthetic oligonucleotide
ggaacuucucuuauaaaaaccaggaaa

SEQ ID NO: 727 - RNA, 27 nt, Artificial Sequence
  Synthetic oligonucleotide
aggaacuucucuuauaaaaaccaggaa

SEQ ID NO: 728 - RNA, 27 nt, Artificial Sequence
  Synthetic oligonucleotide
gaggaacuucucuuauaaaaaccagga

SEQ ID NO: 729 - RNA, 27 nt, Artificial Sequence
  Synthetic oligonucleotide
agaggaacuucucuuauaaaaaccagg

SEQ ID NO: 730 - RNA, 27 nt, Artificial Sequence
  Synthetic oligonucleotide
cagaggaacuucucuuauaaaaaccag

SEQ ID NO: 731 - RNA, 27 nt, Artificial Sequence
  Synthetic oligonucleotide
ucagaggaacuucucuuauaaaaacca

SEQ ID NO: 732 - RNA, 27 nt, Artificial Sequence
  Synthetic oligonucleotide
uucagaggaacuucucuuauaaaaacc

SEQ ID NO: 733 - RNA, 27 nt, Artificial Sequence
  Synthetic oligonucleotide
guucagaggaacuucucuuauaaaaac

SEQ ID NO: 734 - RNA, 27 nt, Artificial Sequence
  Synthetic oligonucleotide
uguucagaggaacuucucuuauaaaaa

SEQ ID NO: 735 - RNA, 27 nt, Artificial Sequence
  Synthetic oligonucleotide
guguucagaggaacuucucuuauaaaa

SEQ ID NO: 736 - RNA, 27 nt, Artificial Sequence
  Synthetic oligonucleotide
aguguucagaggaacuucucuuauaaa

SEQ ID NO: 737 - RNA, 27 nt, Artificial Sequence
  Synthetic oligonucleotide
uaguguucagaggaacuucucuuauaa

SEQ ID NO: 738 - RNA, 27 nt, Artificial Sequence
  Synthetic oligonucleotide
auaguguucagaggaacuucucuuaua

SEQ ID NO: 739 - RNA, 27 nt, Artificial Sequence
  Synthetic oligonucleotide
aauaguguucagaggaacuucucuuau

SEQ ID NO: 740 - RNA, 27 nt, Artificial Sequence
  Synthetic oligonucleotide
uaauaguguucagaggaacuucucuua

SEQ ID NO: 741 - RNA, 27 nt, Artificial Sequence
  Synthetic oligonucleotide
auaauaguguucagaggaacuucucuu

SEQ ID NO: 742 - RNA, 27 nt, Artificial Sequence
  Synthetic oligonucleotide
gauaauaguguucagaggaacuucucu

SEQ ID NO: 743 - RNA, 27 nt, Artificial Sequence
  Synthetic oligonucleotide
agauaauaguguucagaggaacuucuc

SEQ ID NO: 744 - RNA, 27 nt, Artificial Sequence
  Synthetic oligonucleotide
aagauaauaguguucagaggaacuucu

SEQ ID NO: 745 - RNA, 27 nt, Artificial Sequence
  Synthetic oligonucleotide
gaagauaauaguguucagaggaacuuc

SEQ ID NO: 746 - RNA, 27 nt, Artificial Sequence
  Synthetic oligonucleotide
ugaagauaauaguguucagaggaacuu

SEQ ID NO: 747 - RNA, 27 nt, Artificial Sequence
  Synthetic oligonucleotide
augaagauaauaguguucagaggaacu

SEQ ID NO: 748 - RNA, 27 nt, Artificial Sequence
  Synthetic oligonucleotide
caugaagauaauaguguucagaggaac

SEQ ID NO: 749 - RNA, 27 nt, Artificial Sequence
  Synthetic oligonucleotide
ccaugaagauaauaguguucagaggaa

SEQ ID NO: 750 - RNA, 27 nt, Artificial Sequence
  Synthetic oligonucleotide
cccaugaagauaauaguguucagagga

SEQ ID NO: 751 - RNA, 27 nt, Artificial Sequence
  Synthetic oligonucleotide
ugcccaugaagauaauaguguucagag

SEQ ID NO: 752 - RNA, 27 nt, Artificial Sequence
  Synthetic oligonucleotide
uacucugcccaugaagauaauaguguu

SEQ ID NO: 753 - RNA, 27 nt, Artificial Sequence
  Synthetic oligonucleotide
guaguuuguauuuauuuuuacuucugu

SEQ ID NO: 754 - RNA, 27 nt, Artificial Sequence
  Synthetic oligonucleotide
aguaguuuguauuuauuuuuacuucug

SEQ ID NO: 755 - RNA, 27 nt, Artificial Sequence
  Synthetic oligonucleotide
uucugauuaugucuuauaucucaccac

SEQ ID NO: 756 - RNA, 27 nt, Artificial Sequence
  Synthetic oligonucleotide
aauuuaaaaaccuccaucagcugcuug

SEQ ID NO: 757 - RNA, 27 nt, Artificial Sequence
  Synthetic oligonucleotide
ugguaucaaauuuaaaaaccuccauca

SEQ ID NO: 758 - RNA, 27 nt, Artificial Sequence
  Synthetic oligonucleotide
uauaauaguguucagugcaacuucccu

SEQ ID NO: 759 - RNA, 27 nt, Artificial Sequence
  Synthetic oligonucleotide
gaauauaauaguguucagugcaacuuc

SEQ ID NO: 760 - RNA, 27 nt, Artificial Sequence
  Synthetic oligonucleotide
augaauauaauaguguucagugcaacu

SEQ ID NO: 761 - RNA, 27 nt, Artificial Sequence
  Synthetic oligonucleotide
uuacuucuauucacaaacaccaaagua

SEQ ID NO: 762 - RNA, 27 nt, Artificial Sequence
  Synthetic oligonucleotide
auuuuuacuucuauucacaaacaccaa

SEQ ID NO: 763 - RNA, 27 nt, Artificial Sequence
  Synthetic oligonucleotide
uauuuuuacuucuauucacaaacacca

SEQ ID NO: 764 - RNA, 27 nt, Artificial Sequence
  Synthetic oligonucleotide
uuauuuuuacuucuauucacaaacacc

SEQ ID NO: 765 - RNA, 27 nt, Artificial Sequence
  Synthetic oligonucleotide
uuuauuuuuacuucuauucacaaacac

SEQ ID NO: 766 - RNA, 27 nt, Artificial Sequence
  Synthetic oligonucleotide
cguauuuauuuuuacuucuauucacaa

SEQ ID NO: 767 - RNA, 27 nt, Artificial Sequence
  Synthetic oligonucleotide
ugaaauaguaauauauuuaccucuugu

SEQ ID NO: 768 - RNA, 27 nt, Artificial Sequence
  Synthetic oligonucleotide
uuuuuuuguauaaaaaugcauuucucu

SEQ ID NO: 769 - DNA, 27 bp, Artificial Sequence
  Synthetic oligonucleotide
ggccatgtattccaatgtgataggaac

SEQ ID NO: 770 - DNA, 27 bp, Artificial Sequence
  Synthetic oligonucleotide
gccatgtattccaatgtgataggaact

SEQ ID NO: 771 - DNA, 27 bp, Artificial Sequence
  Synthetic oligonucleotide
ccatgtattccaatgtgataggaactg

SEQ ID NO: 772 - DNA, 27 bp, Artificial Sequence
  Synthetic oligonucleotide
catgtattccaatgtgataggaactgt

SEQ ID NO: 773 - DNA, 27 bp, Artificial Sequence
  Synthetic oligonucleotide
atgtattccaatgtgataggaactgta

SEQ ID NO: 774 - DNA, 27 bp, Artificial Sequence
  Synthetic oligonucleotide
tgtattccaatgtgataggaactgtaa

SEQ ID NO: 775 - DNA, 27 bp, Artificial Sequence
  Synthetic oligonucleotide
gtattccaatgtgataggaactgtaac

SEQ ID NO: 776 - DNA, 27 bp, Artificial Sequence
  Synthetic oligonucleotide
acctctggaaaaaggaaggtttatctt

SEQ ID NO: 777 - DNA, 27 bp, Artificial Sequence
  Synthetic oligonucleotide
cctctggaaaaaggaaggtttatcttt

SEQ ID NO: 778 - DNA, 27 bp, Artificial Sequence
  Synthetic oligonucleotide
ctctggaaaaaggaaggtttatctttt

SEQ ID NO: 779 - DNA, 27 bp, Artificial Sequence
  Synthetic oligonucleotide
ctggaaaaaggaaggtttatcttttgt

SEQ ID NO: 780 - DNA, 27 bp, Artificial Sequence
  Synthetic oligonucleotide
tggaaaaaggaaggtttatcttttgtc

SEQ ID NO: 781 - DNA, 27 bp, Artificial Sequence
  Synthetic oligonucleotide
ggaaaaaggaaggtttatcttttgtcc

SEQ ID NO: 782 - DNA, 27 bp, Artificial Sequence
  Synthetic oligonucleotide
attcccatgaatcccatgtgcatttac

SEQ ID NO: 783 - DNA, 27 bp, Artificial Sequence
  Synthetic oligonucleotide
ttcccatgaatcccatgtgcatttacc

SEQ ID NO: 784 - DNA, 27 bp, Artificial Sequence
  Synthetic oligonucleotide
ccatgaatcccatgtgcatttaccgct

SEQ ID NO: 785 - DNA, 27 bp, Artificial Sequence
  Synthetic oligonucleotide
catgtgcatttaccgctccccggagaa

SEQ ID NO: 786 - DNA, 27 bp, Artificial Sequence
  Synthetic oligonucleotide
gtgtctgggaactgtccaaggccaatt

SEQ ID NO: 787 - DNA, 27 bp, Artificial Sequence
  Synthetic oligonucleotide
tgtctgggaactgtccaaggccaattc

SEQ ID NO: 788 - DNA, 27 bp, Artificial Sequence
  Synthetic oligonucleotide
gtctgggaactgtccaaggccaattcc

SEQ ID NO: 789 - DNA, 27 bp, Artificial Sequence
  Synthetic oligonucleotide
tctgggaactgtccaaggccaattccc

SEQ ID NO: 790 - DNA, 27 bp, Artificial Sequence
  Synthetic oligonucleotide
ctgggaactgtccaaggccaattcccg

SEQ ID NO: 791 - DNA, 27 bp, Artificial Sequence
  Synthetic oligonucleotide
tgggaactgtccaaggccaattcccgc

SEQ ID NO: 792 - DNA, 27 bp, Artificial Sequence
  Synthetic oligonucleotide
gggaactgtccaaggccaattcccgct

SEQ ID NO: 793 - DNA, 27 bp, Artificial Sequence
  Synthetic oligonucleotide
ggaactgtccaaggccaattcccgctt

SEQ ID NO: 794 - DNA, 27 bp, Artificial Sequence
  Synthetic oligonucleotide
caattcccgctttgctaccactttcta

SEQ ID NO: 795 - DNA, 27 bp, Artificial Sequence
  Synthetic oligonucleotide
ttcccgctttgctaccactttctatca

SEQ ID NO: 796 - DNA, 27 bp, Artificial Sequence
  Synthetic oligonucleotide
tcccgctttgctaccactttctatcag

SEQ ID NO: 797 - DNA, 27 bp, Artificial Sequence
  Synthetic oligonucleotide
cccgctttgctaccactttctatcagc

SEQ ID NO: 798 - DNA, 27 bp, Artificial Sequence
  Synthetic oligonucleotide
ccgctttgctaccactttctatcagca

SEQ ID NO: 799 - DNA, 27 bp, Artificial Sequence
  Synthetic oligonucleotide
cgctttgctaccactttctatcagcac

SEQ ID NO: 800 - DNA, 27 bp, Artificial Sequence
  Synthetic oligonucleotide
gctttgctaccactttctatcagcacc

SEQ ID NO: 801 - DNA, 27 bp, Artificial Sequence
  Synthetic oligonucleotide
ctttgctaccactttctatcagcacct

SEQ ID NO: 802 - DNA, 27 bp, Artificial Sequence
  Synthetic oligonucleotide
tttgctaccactttctatcagcacctg

SEQ ID NO: 803 - DNA, 27 bp, Artificial Sequence
  Synthetic oligonucleotide
ttgctaccactttctatcagcacctgg

SEQ ID NO: 804 - DNA, 27 bp, Artificial Sequence
  Synthetic oligonucleotide
gcacctggcagattccaagaatgacaa

SEQ ID NO: 805 - DNA, 27 bp, Artificial Sequence
  Synthetic oligonucleotide
atgataacattttcctgtcacccctga

SEQ ID NO: 806 - DNA, 27 bp, Artificial Sequence
  Synthetic oligonucleotide
ataacattttcctgtcacccctgagta

SEQ ID NO: 807 - DNA, 27 bp, Artificial Sequence
  Synthetic oligonucleotide
aacattttcctgtcacccctgagtatc

SEQ ID NO: 808 - DNA, 27 bp, Artificial Sequence
  Synthetic oligonucleotide
cggcttttgctatgaccaagctgggtg

SEQ ID NO: 809 - DNA, 27 bp, Artificial Sequence
  Synthetic oligonucleotide
ggcttttgctatgaccaagctgggtgc

SEQ ID NO: 810 - DNA, 27 bp, Artificial Sequence
  Synthetic oligonucleotide
gcttttgctatgaccaagctgggtgcc

SEQ ID NO: 811 - DNA, 27 bp, Artificial Sequence
  Synthetic oligonucleotide
cttttgctatgaccaagctgggtgcct

SEQ ID NO: 812 - DNA, 27 bp, Artificial Sequence
  Synthetic oligonucleotide
ttttgctatgaccaagctgggtgcctg

SEQ ID NO: 813 - DNA, 27 bp, Artificial Sequence
  Synthetic oligonucleotide
tttgctatgaccaagctgggtgcctgt

SEQ ID NO: 814 - DNA, 27 bp, Artificial Sequence
  Synthetic oligonucleotide
ttgctatgaccaagctgggtgcctgta

SEQ ID NO: 815 - DNA, 27 bp, Artificial Sequence
  Synthetic oligonucleotide
tgctatgaccaagctgggtgcctgtaa

SEQ ID NO: 816 - DNA, 27 bp, Artificial Sequence
  Synthetic oligonucleotide
gctatgaccaagctgggtgcctgtaat

SEQ ID NO: 817 - DNA, 27 bp, Artificial Sequence
  Synthetic oligonucleotide
ctatgaccaagctgggtgcctgtaatg

SEQ ID NO: 818 - DNA, 27 bp, Artificial Sequence
  Synthetic oligonucleotide
tatgaccaagctgggtgcctgtaatga

SEQ ID NO: 819 - DNA, 27 bp, Artificial Sequence
  Synthetic oligonucleotide
atgaccaagctgggtgcctgtaatgac

SEQ ID NO: 820 - DNA, 27 bp, Artificial Sequence
  Synthetic oligonucleotide
tgaccaagctgggtgcctgtaatgaca

SEQ ID NO: 821 - DNA, 27 bp, Artificial Sequence
  Synthetic oligonucleotide
gaccaagctgggtgcctgtaatgacac

SEQ ID NO: 822 - DNA, 27 bp, Artificial Sequence
  Synthetic oligonucleotide
ccagcaactgatggaggtatttaagtt

SEQ ID NO: 823 - DNA, 27 bp, Artificial Sequence
  Synthetic oligonucleotide
cagcaactgatggaggtatttaagttt

SEQ ID NO: 824 - DNA, 27 bp, Artificial Sequence
  Synthetic oligonucleotide
agcaactgatggaggtatttaagtttg

SEQ ID NO: 825 - DNA, 27 bp, Artificial Sequence
  Synthetic oligonucleotide
gcaactgatggaggtatttaagtttga

SEQ ID NO: 826 - DNA, 27 bp, Artificial Sequence
  Synthetic oligonucleotide
caactgatggaggtatttaagtttgac

SEQ ID NO: 827 - DNA, 27 bp, Artificial Sequence
  Synthetic oligonucleotide
aactgatggaggtatttaagtttgaca

SEQ ID NO: 828 - DNA, 27 bp, Artificial Sequence
  Synthetic oligonucleotide
actgatggaggtatttaagtttgacac

SEQ ID NO: 829 - DNA, 27 bp, Artificial Sequence
  Synthetic oligonucleotide
ctgatggaggtatttaagtttgacacc

SEQ ID NO: 830 - DNA, 27 bp, Artificial Sequence
  Synthetic oligonucleotide
tgatggaggtatttaagtttgacacca

SEQ ID NO: 831 - DNA, 27 bp, Artificial Sequence
  Synthetic oligonucleotide
gatggaggtatttaagtttgacaccat

SEQ ID NO: 832 - DNA, 27 bp, Artificial Sequence
  Synthetic oligonucleotide
atggaggtatttaagtttgacaccata

SEQ ID NO: 833 - DNA, 27 bp, Artificial Sequence
  Synthetic oligonucleotide
tggaggtatttaagtttgacaccatat

SEQ ID NO: 834 - DNA, 27 bp, Artificial Sequence
  Synthetic oligonucleotide
ggaggtatttaagtttgacaccatatc

SEQ ID NO: 835 - DNA, 27 bp, Artificial Sequence
  Synthetic oligonucleotide
gaggtatttaagtttgacaccatatct

SEQ ID NO: 836 - DNA, 27 bp, Artificial Sequence
  Synthetic oligonucleotide
aggtatttaagtttgacaccatatctg

SEQ ID NO: 837 - DNA, 27 bp, Artificial Sequence
  Synthetic oligonucleotide
ggtatttaagtttgacaccatatctga

SEQ ID NO: 838 - DNA, 27 bp, Artificial Sequence
  Synthetic oligonucleotide
gtatttaagtttgacaccatatctgag

SEQ ID NO: 839 - DNA, 27 bp, Artificial Sequence
  Synthetic oligonucleotide
tatttaagtttgacaccatatctgaga

SEQ ID NO: 840 - DNA, 27 bp, Artificial Sequence
  Synthetic oligonucleotide
atttaagtttgacaccatatctgagaa

SEQ ID NO: 841 - DNA, 27 bp, Artificial Sequence
  Synthetic oligonucleotide
tttaagtttgacaccatatctgagaaa

SEQ ID NO: 842 - DNA, 27 bp, Artificial Sequence
  Synthetic oligonucleotide
ttaagtttgacaccatatctgagaaaa

SEQ ID NO: 843 - DNA, 27 bp, Artificial Sequence
  Synthetic oligonucleotide
taagtttgacaccatatctgagaaaac

SEQ ID NO: 844 - DNA, 27 bp, Artificial Sequence
  Synthetic oligonucleotide
aagtttgacaccatatctgagaaaaca

SEQ ID NO: 845 - DNA, 27 bp, Artificial Sequence
  Synthetic oligonucleotide
agtttgacaccatatctgagaaaacat

SEQ ID NO: 846 - DNA, 27 bp, Artificial Sequence
  Synthetic oligonucleotide
gtttgacaccatatctgagaaaacatc

SEQ ID NO: 847 - DNA, 27 bp, Artificial Sequence
  Synthetic oligonucleotide
tttgacaccatatctgagaaaacatct

SEQ ID NO: 848 - DNA, 27 bp, Artificial Sequence
  Synthetic oligonucleotide
ttgacaccatatctgagaaaacatctg

SEQ ID NO: 849 - DNA, 27 bp, Artificial Sequence
  Synthetic oligonucleotide
tgacaccatatctgagaaaacatctga

SEQ ID NO: 850 - DNA, 27 bp, Artificial Sequence
  Synthetic oligonucleotide
gacaccatatctgagaaaacatctgat

SEQ ID NO: 851 - DNA, 27 bp, Artificial Sequence
  Synthetic oligonucleotide
acaccatatctgagaaaacatctgatc

SEQ ID NO: 852 - DNA, 27 bp, Artificial Sequence
  Synthetic oligonucleotide
caccatatctgagaaaacatctgatca

SEQ ID NO: 853 - DNA, 27 bp, Artificial Sequence
  Synthetic oligonucleotide
accatatctgagaaaacatctgatcag

SEQ ID NO: 854 - DNA, 27 bp, Artificial Sequence
  Synthetic oligonucleotide
ccatatctgagaaaacatctgatcaga

SEQ ID NO: 855 - DNA, 27 bp, Artificial Sequence
  Synthetic oligonucleotide
catatctgagaaaacatctgatcagat

SEQ ID NO: 856 - DNA, 27 bp, Artificial Sequence
  Synthetic oligonucleotide
atctgagaaaacatctgatcagatcca

SEQ ID NO: 857 - DNA, 27 bp, Artificial Sequence
  Synthetic oligonucleotide
tctgagaaaacatctgatcagatccac

SEQ ID NO: 858 - DNA, 27 bp, Artificial Sequence
  Synthetic oligonucleotide
ctgagaaaacatctgatcagatccact

SEQ ID NO: 859 - DNA, 27 bp, Artificial Sequence
  Synthetic oligonucleotide
tgagaaaacatctgatcagatccactt

SEQ ID NO: 860 - DNA, 27 bp, Artificial Sequence
  Synthetic oligonucleotide
tgatcagatccacttcttctttgccaa

SEQ ID NO: 861 - DNA, 27 bp, Artificial Sequence
  Synthetic oligonucleotide
atcagatccacttcttctttgccaaac

SEQ ID NO: 862 - DNA, 27 bp, Artificial Sequence
  Synthetic oligonucleotide
tcagatccacttcttctttgccaaact

SEQ ID NO: 863 - DNA, 27 bp, Artificial Sequence
  Synthetic oligonucleotide
cagatccacttcttctttgccaaactg

SEQ ID NO: 864 - DNA, 27 bp, Artificial Sequence
  Synthetic oligonucleotide
agatccacttcttctttgccaaactga

SEQ ID NO: 865 - DNA, 27 bp, Artificial Sequence
  Synthetic oligonucleotide
gatccacttcttctttgccaaactgaa

SEQ ID NO: 866 - DNA, 27 bp, Artificial Sequence
  Synthetic oligonucleotide
atccacttcttctttgccaaactgaac

SEQ ID NO: 867 - DNA, 27 bp, Artificial Sequence
  Synthetic oligonucleotide
tccacttcttctttgccaaactgaact

SEQ ID NO: 868 - DNA, 27 bp, Artificial Sequence
  Synthetic oligonucleotide
ccacttcttctttgccaaactgaactg

SEQ ID NO: 869 - DNA, 27 bp, Artificial Sequence
  Synthetic oligonucleotide
cacttcttctttgccaaactgaactgc

SEQ ID NO: 870 - DNA, 27 bp, Artificial Sequence
  Synthetic oligonucleotide
acttcttctttgccaaactgaactgcc

SEQ ID NO: 871 - DNA, 27 bp, Artificial Sequence
  Synthetic oligonucleotide
cttcttctttgccaaactgaactgccg

SEQ ID NO: 872 - DNA, 27 bp, Artificial Sequence
  Synthetic oligonucleotide
ttcttctttgccaaactgaactgccga

SEQ ID NO: 873 - DNA, 27 bp, Artificial Sequence
  Synthetic oligonucleotide
tcttctttgccaaactgaactgccgac

SEQ ID NO: 874 - DNA, 27 bp, Artificial Sequence
  Synthetic oligonucleotide
cttctttgccaaactgaactgccgact

SEQ ID NO: 875 - DNA, 27 bp, Artificial Sequence
  Synthetic oligonucleotide
ttctttgccaaactgaactgccgactc

SEQ ID NO: 876 - DNA, 27 bp, Artificial Sequence
  Synthetic oligonucleotide
tctttgccaaactgaactgccgactct

SEQ ID NO: 877 - DNA, 27 bp, Artificial Sequence
  Synthetic oligonucleotide
ctttgccaaactgaactgccgactcta

SEQ ID NO: 878 - DNA, 27 bp, Artificial Sequence
  Synthetic oligonucleotide
tttgccaaactgaactgccgactctat

SEQ ID NO: 879 - DNA, 27 bp, Artificial Sequence
  Synthetic oligonucleotide
ttgccaaactgaactgccgactctatc

SEQ ID NO: 880 - DNA, 27 bp, Artificial Sequence
  Synthetic oligonucleotide
tgccaaactgaactgccgactctatcg

SEQ ID NO: 881 - DNA, 27 bp, Artificial Sequence
  Synthetic oligonucleotide
gccaaactgaactgccgactctatcga

SEQ ID NO: 882 - DNA, 27 bp, Artificial Sequence
  Synthetic oligonucleotide
ccaaactgaactgccgactctatcgaa

SEQ ID NO: 883 - DNA, 27 bp, Artificial Sequence
  Synthetic oligonucleotide
caaactgaactgccgactctatcgaaa

SEQ ID NO: 884 - DNA, 27 bp, Artificial Sequence
  Synthetic oligonucleotide
aaactgaactgccgactctatcgaaaa

SEQ ID NO: 885 - DNA, 27 bp, Artificial Sequence
  Synthetic oligonucleotide
aactgaactgccgactctatcgaaaag

SEQ ID NO: 886 - DNA, 27 bp, Artificial Sequence
  Synthetic oligonucleotide
actgaactgccgactctatcgaaaagc

SEQ ID NO: 887 - DNA, 27 bp, Artificial Sequence
  Synthetic oligonucleotide
ctgaactgccgactctatcgaaaagcc

SEQ ID NO: 888 - DNA, 27 bp, Artificial Sequence
  Synthetic oligonucleotide
tgaactgccgactctatcgaaaagcca

SEQ ID NO: 889 - DNA, 27 bp, Artificial Sequence
  Synthetic oligonucleotide
gaactgccgactctatcgaaaagccaa

SEQ ID NO: 890 - DNA, 27 bp, Artificial Sequence
  Synthetic oligonucleotide
aactgccgactctatcgaaaagccaac

SEQ ID NO: 891 - DNA, 27 bp, Artificial Sequence
  Synthetic oligonucleotide
actgccgactctatcgaaaagccaaca

SEQ ID NO: 892 - DNA, 27 bp, Artificial Sequence
  Synthetic oligonucleotide
ctgccgactctatcgaaaagccaacaa

SEQ ID NO: 893 - DNA, 27 bp, Artificial Sequence
  Synthetic oligonucleotide
tgccgactctatcgaaaagccaacaaa

SEQ ID NO: 894 - DNA, 27 bp, Artificial Sequence
  Synthetic oligonucleotide
gccgactctatcgaaaagccaacaaat

SEQ ID NO: 895 - DNA, 27 bp, Artificial Sequence
  Synthetic oligonucleotide
ccgactctatcgaaaagccaacaaatc

SEQ ID NO: 896 - DNA, 27 bp, Artificial Sequence
  Synthetic oligonucleotide
cgactctatcgaaaagccaacaaatcc

SEQ ID NO: 897 - DNA, 27 bp, Artificial Sequence
  Synthetic oligonucleotide
gactctatcgaaaagccaacaaatcct

SEQ ID NO: 898 - DNA, 27 bp, Artificial Sequence
  Synthetic oligonucleotide
actctatcgaaaagccaacaaatcctc

SEQ ID NO: 899 - DNA, 27 bp, Artificial Sequence
  Synthetic oligonucleotide
cgaaaagccaacaaatcctccaagtta

SEQ ID NO: 900 - DNA, 27 bp, Artificial Sequence
  Synthetic oligonucleotide
gaaaagccaacaaatcctccaagttag

SEQ ID NO: 901 - DNA, 27 bp, Artificial Sequence
  Synthetic oligonucleotide
aagccaacaaatcctccaagttagtat

SEQ ID NO: 902 - DNA, 27 bp, Artificial Sequence
  Synthetic oligonucleotide
agccaacaaatcctccaagttagtatc

SEQ ID NO: 903 - DNA, 27 bp, Artificial Sequence
  Synthetic oligonucleotide
gccaacaaatcctccaagttagtatca

SEQ ID NO: 904 - DNA, 27 bp, Artificial Sequence
  Synthetic oligonucleotide
ccaacaaatcctccaagttagtatcag

SEQ ID NO: 905 - DNA, 27 bp, Artificial Sequence
  Synthetic oligonucleotide
caacaaatcctccaagttagtatcagc

SEQ ID NO: 906 - DNA, 27 bp, Artificial Sequence
  Synthetic oligonucleotide
aacaaatcctccaagttagtatcagcc

SEQ ID NO: 907 - DNA, 27 bp, Artificial Sequence
  Synthetic oligonucleotide
caagttagtatcagccaatcgcctttt

SEQ ID NO: 908 - DNA, 27 bp, Artificial Sequence
  Synthetic oligonucleotide
ttagtatcagccaatcgcctttttgga

SEQ ID NO: 909 - DNA, 27 bp, Artificial Sequence
  Synthetic oligonucleotide
atcagccaatcgcctttttggagacaa

SEQ ID NO: 910 - DNA, 27 bp, Artificial Sequence
  Synthetic oligonucleotide
tcagccaatcgcctttttggagacaaa

SEQ ID NO: 911 - DNA, 27 bp, Artificial Sequence
  Synthetic oligonucleotide
cagccaatcgcctttttggagacaaat

SEQ ID NO: 912 - DNA, 27 bp, Artificial Sequence
  Synthetic oligonucleotide
caatcgcctttttggagacaaatccct

SEQ ID NO: 913 - DNA, 27 bp, Artificial Sequence
  Synthetic oligonucleotide
atcgcctttttggagacaaatccctta

SEQ ID NO: 914 - DNA, 27 bp, Artificial Sequence
  Synthetic oligonucleotide
tcgcctttttggagacaaatcccttac

SEQ ID NO: 915 - DNA, 27 bp, Artificial Sequence
  Synthetic oligonucleotide
cgcctttttggagacaaatcccttacc

SEQ ID NO: 916 - DNA, 27 bp, Artificial Sequence
  Synthetic oligonucleotide
gcctttttggagacaaatcccttacct

SEQ ID NO: 917 - DNA, 27 bp, Artificial Sequence
  Synthetic oligonucleotide
cctttttggagacaaatcccttacctt

SEQ ID NO: 918 - DNA, 27 bp, Artificial Sequence
  Synthetic oligonucleotide
tttggagacaaatcccttaccttcaat

SEQ ID NO: 919 - DNA, 27 bp, Artificial Sequence
  Synthetic oligonucleotide
ttggagacaaatcccttaccttcaatg

SEQ ID NO: 920 - DNA, 27 bp, Artificial Sequence
  Synthetic oligonucleotide
tggagacaaatcccttaccttcaatga

SEQ ID NO: 921 - DNA, 27 bp, Artificial Sequence
  Synthetic oligonucleotide
ggagacaaatcccttaccttcaatgag

SEQ ID NO: 922 - DNA, 27 bp, Artificial Sequence
  Synthetic oligonucleotide
gagacaaatcccttaccttcaatgaga

SEQ ID NO: 923 - DNA, 27 bp, Artificial Sequence
  Synthetic oligonucleotide
agacaaatcccttaccttcaatgagac

SEQ ID NO: 924 - DNA, 27 bp, Artificial Sequence
  Synthetic oligonucleotide
acaaatcccttaccttcaatgagacct

SEQ ID NO: 925 - DNA, 27 bp, Artificial Sequence
  Synthetic oligonucleotide
caaatcccttaccttcaatgagaccta

SEQ ID NO: 926 - DNA, 27 bp, Artificial Sequence
  Synthetic oligonucleotide
aaatcccttaccttcaatgagacctac

SEQ ID NO: 927 - DNA, 27 bp, Artificial Sequence
  Synthetic oligonucleotide
ttaccttcaatgagacctaccaggaca

SEQ ID NO: 928 - DNA, 27 bp, Artificial Sequence
  Synthetic oligonucleotide
cttcaatgagacctaccaggacatcag

SEQ ID NO: 929 - DNA, 27 bp, Artificial Sequence
  Synthetic oligonucleotide
ttcaatgagacctaccaggacatcagt

SEQ ID NO: 930 - DNA, 27 bp, Artificial Sequence
  Synthetic oligonucleotide
tcaatgagacctaccaggacatcagtg

SEQ ID NO: 931 - DNA, 27 bp, Artificial Sequence
  Synthetic oligonucleotide
aatgagacctaccaggacatcagtgag

SEQ ID NO: 932 - DNA, 27 bp, Artificial Sequence
  Synthetic oligonucleotide
tgagacctaccaggacatcagtgagtt

SEQ ID NO: 933 - DNA, 27 bp, Artificial Sequence
  Synthetic oligonucleotide
acctaccaggacatcagtgagttggta

SEQ ID NO: 934 - DNA, 27 bp, Artificial Sequence
  Synthetic oligonucleotide
cctaccaggacatcagtgagttggtat

SEQ ID NO: 935 - DNA, 27 bp, Artificial Sequence
  Synthetic oligonucleotide
ctaccaggacatcagtgagttggtata

SEQ ID NO: 936 - DNA, 27 bp, Artificial Sequence
  Synthetic oligonucleotide
taccaggacatcagtgagttggtatat

SEQ ID NO: 937 - DNA, 27 bp, Artificial Sequence
  Synthetic oligonucleotide
accaggacatcagtgagttggtatatg

SEQ ID NO: 938 - DNA, 27 bp, Artificial Sequence
  Synthetic oligonucleotide
ccaggacatcagtgagttggtatatgg

SEQ ID NO: 939 - DNA, 27 bp, Artificial Sequence
  Synthetic oligonucleotide
caggacatcagtgagttggtatatgga

SEQ ID NO: 940 - DNA, 27 bp, Artificial Sequence
  Synthetic oligonucleotide
aggacatcagtgagttggtatatggag

SEQ ID NO: 941 - DNA, 27 bp, Artificial Sequence
  Synthetic oligonucleotide
ggacatcagtgagttggtatatggagc

SEQ ID NO: 942 - DNA, 27 bp, Artificial Sequence
  Synthetic oligonucleotide
tatatggagccaagctccagcccctgg

SEQ ID NO: 943 - DNA, 27 bp, Artificial Sequence
  Synthetic oligonucleotide
atatggagccaagctccagcccctgga

SEQ ID NO: 944 - DNA, 27 bp, Artificial Sequence
  Synthetic oligonucleotide
tatggagccaagctccagcccctggac

SEQ ID NO: 945 - DNA, 27 bp, Artificial Sequence
  Synthetic oligonucleotide
atggagccaagctccagcccctggact

SEQ ID NO: 946 - DNA, 27 bp, Artificial Sequence
  Synthetic oligonucleotide
tggagccaagctccagcccctggactt

SEQ ID NO: 947 - DNA, 27 bp, Artificial Sequence
  Synthetic oligonucleotide
ggagccaagctccagcccctggacttc

SEQ ID NO: 948 - DNA, 27 bp, Artificial Sequence
  Synthetic oligonucleotide
gagccaagctccagcccctggacttca

SEQ ID NO: 949 - DNA, 27 bp, Artificial Sequence
  Synthetic oligonucleotide
agccaagctccagcccctggacttcaa

SEQ ID NO: 950 - DNA, 27 bp, Artificial Sequence
  Synthetic oligonucleotide
gccaagctccagcccctggacttcaag

SEQ ID NO: 951 - DNA, 27 bp, Artificial Sequence
  Synthetic oligonucleotide
ccaagctccagcccctggacttcaagg

SEQ ID NO: 952 - DNA, 27 bp, Artificial Sequence
  Synthetic oligonucleotide
caagctccagcccctggacttcaagga

SEQ ID NO: 953 - DNA, 27 bp, Artificial Sequence
  Synthetic oligonucleotide
aagctccagcccctggacttcaaggaa

SEQ ID NO: 954 - DNA, 27 bp, Artificial Sequence
  Synthetic oligonucleotide
agctccagcccctggacttcaaggaaa

SEQ ID NO: 955 - DNA, 27 bp, Artificial Sequence
  Synthetic oligonucleotide
gctccagcccctggacttcaaggaaaa

SEQ ID NO: 956 - DNA, 27 bp, Artificial Sequence
  Synthetic oligonucleotide
ctccagcccctggacttcaaggaaaat

SEQ ID NO: 957 - DNA, 27 bp, Artificial Sequence
  Synthetic oligonucleotide
tccagcccctggacttcaaggaaaatg

SEQ ID NO: 958 - DNA, 27 bp, Artificial Sequence
  Synthetic oligonucleotide
ccagcccctggacttcaaggaaaatgc

SEQ ID NO: 959 - DNA, 27 bp, Artificial Sequence
  Synthetic oligonucleotide
cagcccctggacttcaaggaaaatgca

SEQ ID NO: 960 - DNA, 27 bp, Artificial Sequence
  Synthetic oligonucleotide
cctggacttcaaggaaaatgcagagca

SEQ ID NO: 961 - DNA, 27 bp, Artificial Sequence
  Synthetic oligonucleotide
ctggacttcaaggaaaatgcagagcaa

SEQ ID NO: 962 - DNA, 27 bp, Artificial Sequence
  Synthetic oligonucleotide
tggacttcaaggaaaatgcagagcaat

SEQ ID NO: 963 - DNA, 27 bp, Artificial Sequence
  Synthetic oligonucleotide
ggacttcaaggaaaatgcagagcaatc

SEQ ID NO: 964 - DNA, 27 bp, Artificial Sequence
  Synthetic oligonucleotide
acttcaaggaaaatgcagagcaatcca

SEQ ID NO: 965 - DNA, 27 bp, Artificial Sequence
  Synthetic oligonucleotide
cttcaaggaaaatgcagagcaatccag

SEQ ID NO: 966 - DNA, 27 bp, Artificial Sequence
  Synthetic oligonucleotide
ttcaaggaaaatgcagagcaatccaga

SEQ ID NO: 967 - DNA, 27 bp, Artificial Sequence
  Synthetic oligonucleotide
tcaaggaaaatgcagagcaatccagag

SEQ ID NO: 968 - DNA, 27 bp, Artificial Sequence
  Synthetic oligonucleotide
gccatcaacaaatgggtgtccaataag

SEQ ID NO: 969 - DNA, 27 bp, Artificial Sequence
  Synthetic oligonucleotide
ccatcaacaaatgggtgtccaataaga

SEQ ID NO: 970 - DNA, 27 bp, Artificial Sequence
  Synthetic oligonucleotide
aacaaatgggtgtccaataagaccgaa

SEQ ID NO: 971 - DNA, 27 bp, Artificial Sequence
  Synthetic oligonucleotide
atgagctcactgttctggtgctggtta

SEQ ID NO: 972 - DNA, 27 bp, Artificial Sequence
  Synthetic oligonucleotide
gagctcactgttctggtgctggttaac

SEQ ID NO: 973 - DNA, 27 bp, Artificial Sequence
  Synthetic oligonucleotide
agctcactgttctggtgctggttaaca

SEQ ID NO: 974 - DNA, 27 bp, Artificial Sequence
  Synthetic oligonucleotide
gctcactgttctggtgctggttaacac

SEQ ID NO: 975 - DNA, 27 bp, Artificial Sequence
  Synthetic oligonucleotide
ctcactgttctggtgctggttaacacc

SEQ ID NO: 976 - DNA, 27 bp, Artificial Sequence
  Synthetic oligonucleotide
tcactgttctggtgctggttaacacca

SEQ ID NO: 977 - DNA, 27 bp, Artificial Sequence
  Synthetic oligonucleotide
cactgttctggtgctggttaacaccat

SEQ ID NO: 978 - DNA, 27 bp, Artificial Sequence
  Synthetic oligonucleotide
actgttctggtgctggttaacaccatt

SEQ ID NO: 979 - DNA, 27 bp, Artificial Sequence
  Synthetic oligonucleotide
ctgttctggtgctggttaacaccattt

SEQ ID NO: 980 - DNA, 27 bp, Artificial Sequence
  Synthetic oligonucleotide
tgttctggtgctggttaacaccattta

SEQ ID NO: 981 - DNA, 27 bp, Artificial Sequence
  Synthetic oligonucleotide
gttctggtgctggttaacaccatttac

SEQ ID NO: 982 - DNA, 27 bp, Artificial Sequence
  Synthetic oligonucleotide
ttctggtgctggttaacaccatttact

SEQ ID NO: 983 - DNA, 27 bp, Artificial Sequence
  Synthetic oligonucleotide
tctggtgctggttaacaccatttactt

SEQ ID NO: 984 - DNA, 27 bp, Artificial Sequence
  Synthetic oligonucleotide
ctggtgctggttaacaccatttacttc

SEQ ID NO: 985 - DNA, 27 bp, Artificial Sequence
  Synthetic oligonucleotide
tggtgctggttaacaccatttacttca

SEQ ID NO: 986 - DNA, 27 bp, Artificial Sequence
  Synthetic oligonucleotide
ggtgctggttaacaccatttacttcaa

SEQ ID NO: 987 - DNA, 27 bp, Artificial Sequence
  Synthetic oligonucleotide
gtgctggttaacaccatttacttcaag

SEQ ID NO: 988 - DNA, 27 bp, Artificial Sequence
  Synthetic oligonucleotide
tgctggttaacaccatttacttcaagg

SEQ ID NO: 989 - DNA, 27 bp, Artificial Sequence
  Synthetic oligonucleotide
gctggttaacaccatttacttcaaggg

SEQ ID NO: 990 - DNA, 27 bp, Artificial Sequence
  Synthetic oligonucleotide
ctggttaacaccatttacttcaagggc

SEQ ID NO: 991 - DNA, 27 bp, Artificial Sequence
  Synthetic oligonucleotide
tggttaacaccatttacttcaagggcc

SEQ ID NO: 992 - DNA, 27 bp, Artificial Sequence
  Synthetic oligonucleotide
ggttaacaccatttacttcaagggcct

SEQ ID NO: 993 - DNA, 27 bp, Artificial Sequence
  Synthetic oligonucleotide
gttaacaccatttacttcaagggcctg

SEQ ID NO: 994 - DNA, 27 bp, Artificial Sequence
  Synthetic oligonucleotide
ttaacaccatttacttcaagggcctgt

SEQ ID NO: 995 - DNA, 27 bp, Artificial Sequence
  Synthetic oligonucleotide
taacaccatttacttcaagggcctgtg

SEQ ID NO: 996 - DNA, 27 bp, Artificial Sequence
  Synthetic oligonucleotide
aacaccatttacttcaagggcctgtgg

SEQ ID NO: 997 - DNA, 27 bp, Artificial Sequence
  Synthetic oligonucleotide
acaccatttacttcaagggcctgtgga

SEQ ID NO: 998 - DNA, 27 bp, Artificial Sequence
  Synthetic oligonucleotide
caccatttacttcaagggcctgtggaa

SEQ ID NO: 999 - DNA, 27 bp, Artificial Sequence
  Synthetic oligonucleotide
accatttacttcaagggcctgtggaag

SEQ ID NO: 1000 - DNA, 27 bp, Artificial Sequence
  Synthetic oligonucleotide
ccatttacttcaagggcctgtggaagt

SEQ ID NO: 1001 - DNA, 27 bp, Artificial Sequence
  Synthetic oligonucleotide
catttacttcaagggcctgtggaagtc

SEQ ID NO: 1002 - DNA, 27 bp, Artificial Sequence
  Synthetic oligonucleotide
atttacttcaagggcctgtggaagtca

SEQ ID NO: 1003 - DNA, 27 bp, Artificial Sequence
  Synthetic oligonucleotide
tttacttcaagggcctgtggaagtcaa

SEQ ID NO: 1004 - DNA, 27 bp, Artificial Sequence
  Synthetic oligonucleotide
ttacttcaagggcctgtggaagtcaaa

SEQ ID NO: 1005 - DNA, 27 bp, Artificial Sequence
  Synthetic oligonucleotide
tacttcaagggcctgtggaagtcaaag

SEQ ID NO: 1006 - DNA, 27 bp, Artificial Sequence
  Synthetic oligonucleotide
acttcaagggcctgtggaagtcaaagt

SEQ ID NO: 1007 - DNA, 27 bp, Artificial Sequence
  Synthetic oligonucleotide
cttcaagggcctgtggaagtcaaagtt

SEQ ID NO: 1008 - DNA, 27 bp, Artificial Sequence
  Synthetic oligonucleotide
ttcaagggcctgtggaagtcaaagttc

SEQ ID NO: 1009 - DNA, 27 bp, Artificial Sequence
  Synthetic oligonucleotide
tcaagggcctgtggaagtcaaagttca

SEQ ID NO: 1010 - DNA, 27 bp, Artificial Sequence
  Synthetic oligonucleotide
caagggcctgtggaagtcaaagttcag

SEQ ID NO: 1011 - DNA, 27 bp, Artificial Sequence
  Synthetic oligonucleotide
aagggcctgtggaagtcaaagttcagc

SEQ ID NO: 1012 - DNA, 27 bp, Artificial Sequence
  Synthetic oligonucleotide
agggcctgtggaagtcaaagttcagcc

SEQ ID NO: 1013 - DNA, 27 bp, Artificial Sequence
  Synthetic oligonucleotide
gggcctgtggaagtcaaagttcagccc

SEQ ID NO: 1014 - DNA, 27 bp, Artificial Sequence
  Synthetic oligonucleotide
ggcctgtggaagtcaaagttcagccct

SEQ ID NO: 1015 - DNA, 27 bp, Artificial Sequence
  Synthetic oligonucleotide
gcctgtggaagtcaaagttcagccctg

SEQ ID NO: 1016 - DNA, 27 bp, Artificial Sequence
  Synthetic oligonucleotide
cctgtggaagtcaaagttcagccctga

SEQ ID NO: 1017 - DNA, 27 bp, Artificial Sequence
  Synthetic oligonucleotide
ctgtggaagtcaaagttcagccctgag

SEQ ID NO: 1018 - DNA, 27 bp, Artificial Sequence
  Synthetic oligonucleotide
tgtggaagtcaaagttcagccctgaga

SEQ ID NO: 1019 - DNA, 27 bp, Artificial Sequence
  Synthetic oligonucleotide
gtggaagtcaaagttcagccctgagaa

SEQ ID NO: 1020 - DNA, 27 bp, Artificial Sequence
  Synthetic oligonucleotide
tggaagtcaaagttcagccctgagaac

SEQ ID NO: 1021 - DNA, 27 bp, Artificial Sequence
  Synthetic oligonucleotide
ggaagtcaaagttcagccctgagaaca

SEQ ID NO: 1022 - DNA, 27 bp, Artificial Sequence
  Synthetic oligonucleotide
gaagtcaaagttcagccctgagaacac

SEQ ID NO: 1023 - DNA, 27 bp, Artificial Sequence
  Synthetic oligonucleotide
tacaaggctgatggagagtcgtgttca

SEQ ID NO: 1024 - DNA, 27 bp, Artificial Sequence
  Synthetic oligonucleotide
ctgatggagagtcgtgttcagcatcta

SEQ ID NO: 1025 - DNA, 27 bp, Artificial Sequence
  Synthetic oligonucleotide
tgatggagagtcgtgttcagcatctat

SEQ ID NO: 1026 - DNA, 27 bp, Artificial Sequence
  Synthetic oligonucleotide
atctatgatgtaccaggaaggcaagtt

SEQ ID NO: 1027 - DNA, 27 bp, Artificial Sequence
  Synthetic oligonucleotide
tctatgatgtaccaggaaggcaagttc

SEQ ID NO: 1028 - DNA, 27 bp, Artificial Sequence
  Synthetic oligonucleotide
ctatgatgtaccaggaaggcaagttcc

SEQ ID NO: 1029 - DNA, 27 bp, Artificial Sequence
  Synthetic oligonucleotide
tatgatgtaccaggaaggcaagttccg

SEQ ID NO: 1030 - DNA, 27 bp, Artificial Sequence
  Synthetic oligonucleotide
tgatgtaccaggaaggcaagttccgtt

SEQ ID NO: 1031 - DNA, 27 bp, Artificial Sequence
  Synthetic oligonucleotide
acccaggtgcttgagttgcccttcaaa

SEQ ID NO: 1032 - DNA, 27 bp, Artificial Sequence
  Synthetic oligonucleotide
caggtgcttgagttgcccttcaaaggt

SEQ ID NO: 1033 - DNA, 27 bp, Artificial Sequence
  Synthetic oligonucleotide
aggtgcttgagttgcccttcaaaggtg

SEQ ID NO: 1034 - DNA, 27 bp, Artificial Sequence
  Synthetic oligonucleotide
ggtgcttgagttgcccttcaaaggtga

SEQ ID NO: 1035 - DNA, 27 bp, Artificial Sequence
  Synthetic oligonucleotide
aaggtgatgacatcaccatggtcctca

SEQ ID NO: 1036 - DNA, 27 bp, Artificial Sequence
  Synthetic oligonucleotide
aggtgatgacatcaccatggtcctcat

SEQ ID NO: 1037 - DNA, 27 bp, Artificial Sequence
  Synthetic oligonucleotide
cttgcccaagcctgagaagagcctggc

SEQ ID NO: 1038 - DNA, 27 bp, Artificial Sequence
  Synthetic oligonucleotide
ttgcccaagcctgagaagagcctggcc

SEQ ID NO: 1039 - DNA, 27 bp, Artificial Sequence
  Synthetic oligonucleotide
tgcccaagcctgagaagagcctggcca

SEQ ID NO: 1040 - DNA, 27 bp, Artificial Sequence
  Synthetic oligonucleotide
gcccaagcctgagaagagcctggccaa

SEQ ID NO: 1041 - DNA, 27 bp, Artificial Sequence
  Synthetic oligonucleotide
cccaagcctgagaagagcctggccaag

SEQ ID NO: 1042 - DNA, 27 bp, Artificial Sequence
  Synthetic oligonucleotide
ccaagcctgagaagagcctggccaagg

SEQ ID NO: 1043 - DNA, 27 bp, Artificial Sequence
  Synthetic oligonucleotide
caagcctgagaagagcctggccaaggt

SEQ ID NO: 1044 - DNA, 27 bp, Artificial Sequence
  Synthetic oligonucleotide
aagcctgagaagagcctggccaaggta

SEQ ID NO: 1045 - DNA, 27 bp, Artificial Sequence
  Synthetic oligonucleotide
agcctgagaagagcctggccaaggtag

SEQ ID NO: 1046 - DNA, 27 bp, Artificial Sequence
  Synthetic oligonucleotide
gcctgagaagagcctggccaaggtaga

SEQ ID NO: 1047 - DNA, 27 bp, Artificial Sequence
  Synthetic oligonucleotide
cctgagaagagcctggccaaggtagag

SEQ ID NO: 1048 - DNA, 27 bp, Artificial Sequence
  Synthetic oligonucleotide
ctgagaagagcctggccaaggtagaga

SEQ ID NO: 1049 - DNA, 27 bp, Artificial Sequence
  Synthetic oligonucleotide
tgagaagagcctggccaaggtagagaa

SEQ ID NO: 1050 - DNA, 27 bp, Artificial Sequence
  Synthetic oligonucleotide
tggtggtccacatgccccgcttccgca

SEQ ID NO: 1051 - DNA, 27 bp, Artificial Sequence
  Synthetic oligonucleotide
ggtggtccacatgccccgcttccgcat

SEQ ID NO: 1052 - DNA, 27 bp, Artificial Sequence
  Synthetic oligonucleotide
gtggtccacatgccccgcttccgcatt

SEQ ID NO: 1053 - DNA, 27 bp, Artificial Sequence
  Synthetic oligonucleotide
tggtccacatgccccgcttccgcattg

SEQ ID NO: 1054 - DNA, 27 bp, Artificial Sequence
  Synthetic oligonucleotide
ggtccacatgccccgcttccgcattga

SEQ ID NO: 1055 - DNA, 27 bp, Artificial Sequence
  Synthetic oligonucleotide
gtccacatgccccgcttccgcattgag

SEQ ID NO: 1056 - DNA, 27 bp, Artificial Sequence
  Synthetic oligonucleotide
tccacatgccccgcttccgcattgagg

SEQ ID NO: 1057 - DNA, 27 bp, Artificial Sequence
  Synthetic oligonucleotide
tcagtttgaaggagcagctgcaagaca

SEQ ID NO: 1058 - DNA, 27 bp, Artificial Sequence
  Synthetic oligonucleotide
cagtttgaaggagcagctgcaagacat

SEQ ID NO: 1059 - DNA, 27 bp, Artificial Sequence
  Synthetic oligonucleotide
tttgaaggagcagctgcaagacatggg

SEQ ID NO: 1060 - DNA, 27 bp, Artificial Sequence
  Synthetic oligonucleotide
ttgaaggagcagctgcaagacatgggc

SEQ ID NO: 1061 - DNA, 27 bp, Artificial Sequence
  Synthetic oligonucleotide
tgaaggagcagctgcaagacatgggcc

SEQ ID NO: 1062 - DNA, 27 bp, Artificial Sequence
  Synthetic oligonucleotide
gaaggagcagctgcaagacatgggcct

SEQ ID NO: 1063 - DNA, 27 bp, Artificial Sequence
  Synthetic oligonucleotide
aaggagcagctgcaagacatgggcctt

SEQ ID NO: 1064 - DNA, 27 bp, Artificial Sequence
  Synthetic oligonucleotide
aggagcagctgcaagacatgggccttg

SEQ ID NO: 1065 - DNA, 27 bp, Artificial Sequence
  Synthetic oligonucleotide
ggagcagctgcaagacatgggccttgt

SEQ ID NO: 1066 - DNA, 27 bp, Artificial Sequence
  Synthetic oligonucleotide
gagcagctgcaagacatgggccttgtc

SEQ ID NO: 1067 - DNA, 27 bp, Artificial Sequence
  Synthetic oligonucleotide
agcagctgcaagacatgggccttgtcg

SEQ ID NO: 1068 - DNA, 27 bp, Artificial Sequence
  Synthetic oligonucleotide
gcagctgcaagacatgggccttgtcga

SEQ ID NO: 1069 - DNA, 27 bp, Artificial Sequence
  Synthetic oligonucleotide
ccttgtcgatctgttcagccctgaaaa

SEQ ID NO: 1070 - DNA, 27 bp, Artificial Sequence
  Synthetic oligonucleotide
ttgtcgatctgttcagccctgaaaagt

SEQ ID NO: 1071 - DNA, 27 bp, Artificial Sequence
  Synthetic oligonucleotide
tgtcgatctgttcagccctgaaaagtc

SEQ ID NO: 1072 - DNA, 27 bp, Artificial Sequence
  Synthetic oligonucleotide
tcgatctgttcagccctgaaaagtcca

SEQ ID NO: 1073 - DNA, 27 bp, Artificial Sequence
  Synthetic oligonucleotide
atctgttcagccctgaaaagtccaaac

SEQ ID NO: 1074 - DNA, 27 bp, Artificial Sequence
  Synthetic oligonucleotide
ctgttcagccctgaaaagtccaaactc

SEQ ID NO: 1075 - DNA, 27 bp, Artificial Sequence
  Synthetic oligonucleotide
gaaaagtccaaactcccaggtattgtt

SEQ ID NO: 1076 - DNA, 27 bp, Artificial Sequence
  Synthetic oligonucleotide
aaaagtccaaactcccaggtattgttg

SEQ ID NO: 1077 - DNA, 27 bp, Artificial Sequence
  Synthetic oligonucleotide
aagtccaaactcccaggtattgttgca

SEQ ID NO: 1078 - DNA, 27 bp, Artificial Sequence
  Synthetic oligonucleotide
gtccaaactcccaggtattgttgcaga

SEQ ID NO: 1079 - DNA, 27 bp, Artificial Sequence
  Synthetic oligonucleotide
tccaaactcccaggtattgttgcagaa

SEQ ID NO: 1080 - DNA, 27 bp, Artificial Sequence
  Synthetic oligonucleotide
ccaaactcccaggtattgttgcagaag

SEQ ID NO: 1081 - DNA, 27 bp, Artificial Sequence
  Synthetic oligonucleotide
caaactcccaggtattgttgcagaagg

SEQ ID NO: 1082 - DNA, 27 bp, Artificial Sequence
  Synthetic oligonucleotide
tccataaggcatttcttgaggtaaatg

SEQ ID NO: 1083 - DNA, 27 bp, Artificial Sequence
  Synthetic oligonucleotide
ccataaggcatttcttgaggtaaatga

SEQ ID NO: 1084 - DNA, 27 bp, Artificial Sequence
  Synthetic oligonucleotide
cataaggcatttcttgaggtaaatgaa

SEQ ID NO: 1085 - DNA, 27 bp, Artificial Sequence
  Synthetic oligonucleotide
ataaggcatttcttgaggtaaatgaag

SEQ ID NO: 1086 - DNA, 27 bp, Artificial Sequence
  Synthetic oligonucleotide
taaggcatttcttgaggtaaatgaaga

SEQ ID NO: 1087 - DNA, 27 bp, Artificial Sequence
  Synthetic oligonucleotide
aaggcatttcttgaggtaaatgaagaa

SEQ ID NO: 1088 - DNA, 27 bp, Artificial Sequence
  Synthetic oligonucleotide
aggcatttcttgaggtaaatgaagaag

SEQ ID NO: 1089 - DNA, 27 bp, Artificial Sequence
  Synthetic oligonucleotide
ggcatttcttgaggtaaatgaagaagg

SEQ ID NO: 1090 - DNA, 27 bp, Artificial Sequence
  Synthetic oligonucleotide
cttgaggtaaatgaagaaggcagtgaa

SEQ ID NO: 1091 - DNA, 27 bp, Artificial Sequence
  Synthetic oligonucleotide
ttgaggtaaatgaagaaggcagtgaag

SEQ ID NO: 1092 - DNA, 27 bp, Artificial Sequence
  Synthetic oligonucleotide
tgaggtaaatgaagaaggcagtgaagc

SEQ ID NO: 1093 - DNA, 27 bp, Artificial Sequence
  Synthetic oligonucleotide
gaggtaaatgaagaaggcagtgaagca

SEQ ID NO: 1094 - DNA, 27 bp, Artificial Sequence
  Synthetic oligonucleotide
aggtaaatgaagaaggcagtgaagcag

SEQ ID NO: 1095 - DNA, 27 bp, Artificial Sequence
  Synthetic oligonucleotide
ggtaaatgaagaaggcagtgaagcagc

SEQ ID NO: 1096 - DNA, 27 bp, Artificial Sequence
  Synthetic oligonucleotide
gtaaatgaagaaggcagtgaagcagct

SEQ ID NO: 1097 - DNA, 27 bp, Artificial Sequence
  Synthetic oligonucleotide
tgaagaaggcagtgaagcagctgcaag

SEQ ID NO: 1098 - DNA, 27 bp, Artificial Sequence
  Synthetic oligonucleotide
agaaggcagtgaagcagctgcaagtac

SEQ ID NO: 1099 - DNA, 27 bp, Artificial Sequence
  Synthetic oligonucleotide
gaaggcagtgaagcagctgcaagtacc

SEQ ID NO: 1100 - DNA, 27 bp, Artificial Sequence
  Synthetic oligonucleotide
tgaagcagctgcaagtaccgctgttgt

SEQ ID NO: 1101 - DNA, 27 bp, Artificial Sequence
  Synthetic oligonucleotide
ccaacaggcctttcctggtttttataa

SEQ ID NO: 1102 - DNA, 27 bp, Artificial Sequence
  Synthetic oligonucleotide
caacaggcctttcctggtttttataag

SEQ ID NO: 1103 - DNA, 27 bp, Artificial Sequence
  Synthetic oligonucleotide
aacaggcctttcctggtttttataaga

SEQ ID NO: 1104 - DNA, 27 bp, Artificial Sequence
  Synthetic oligonucleotide
acaggcctttcctggtttttataagag

SEQ ID NO: 1105 - DNA, 27 bp, Artificial Sequence
  Synthetic oligonucleotide
caggcctttcctggtttttataagaga

SEQ ID NO: 1106 - DNA, 27 bp, Artificial Sequence
  Synthetic oligonucleotide
aggcctttcctggtttttataagagaa

SEQ ID NO: 1107 - DNA, 27 bp, Artificial Sequence
  Synthetic oligonucleotide
gcctttcctggtttttataagagaagt

SEQ ID NO: 1108 - DNA, 27 bp, Artificial Sequence
  Synthetic oligonucleotide
cctttcctggtttttataagagaagtt

SEQ ID NO: 1109 - DNA, 27 bp, Artificial Sequence
  Synthetic oligonucleotide
ctttcctggtttttataagagaagttc

SEQ ID NO: 1110 - DNA, 27 bp, Artificial Sequence
  Synthetic oligonucleotide
tttcctggtttttataagagaagttcc

SEQ ID NO: 1111 - DNA, 27 bp, Artificial Sequence
  Synthetic oligonucleotide
ttcctggtttttataagagaagttcct

SEQ ID NO: 1112 - DNA, 27 bp, Artificial Sequence
  Synthetic oligonucleotide
tcctggtttttataagagaagttcctc

SEQ ID NO: 1113 - DNA, 27 bp, Artificial Sequence
  Synthetic oligonucleotide
cctggtttttataagagaagttcctct

SEQ ID NO: 1114 - DNA, 27 bp, Artificial Sequence
  Synthetic oligonucleotide
ctggtttttataagagaagttcctctg

SEQ ID NO: 1115 - DNA, 27 bp, Artificial Sequence
  Synthetic oligonucleotide
tggtttttataagagaagttcctctga

SEQ ID NO: 1116 - DNA, 27 bp, Artificial Sequence
  Synthetic oligonucleotide
ggtttttataagagaagttcctctgaa

SEQ ID NO: 1117 - DNA, 27 bp, Artificial Sequence
  Synthetic oligonucleotide
gtttttataagagaagttcctctgaac

SEQ ID NO: 1118 - DNA, 27 bp, Artificial Sequence
  Synthetic oligonucleotide
tttttataagagaagttcctctgaaca

SEQ ID NO: 1119 - DNA, 27 bp, Artificial Sequence
  Synthetic oligonucleotide
ttttataagagaagttcctctgaacac

SEQ ID NO: 1120 - DNA, 27 bp, Artificial Sequence
  Synthetic oligonucleotide
tttataagagaagttcctctgaacact

SEQ ID NO: 1121 - DNA, 27 bp, Artificial Sequence
  Synthetic oligonucleotide
ttataagagaagttcctctgaacacta

SEQ ID NO: 1122 - DNA, 27 bp, Artificial Sequence
  Synthetic oligonucleotide
tataagagaagttcctctgaacactat

SEQ ID NO: 1123 - DNA, 27 bp, Artificial Sequence
  Synthetic oligonucleotide
ataagagaagttcctctgaacactatt

SEQ ID NO: 1124 - DNA, 27 bp, Artificial Sequence
  Synthetic oligonucleotide
taagagaagttcctctgaacactatta

SEQ ID NO: 1125 - DNA, 27 bp, Artificial Sequence
  Synthetic oligonucleotide
aagagaagttcctctgaacactattat

SEQ ID NO: 1126 - DNA, 27 bp, Artificial Sequence
  Synthetic oligonucleotide
agagaagttcctctgaacactattatc

SEQ ID NO: 1127 - DNA, 27 bp, Artificial Sequence
  Synthetic oligonucleotide
gagaagttcctctgaacactattatct

SEQ ID NO: 1128 - DNA, 27 bp, Artificial Sequence
  Synthetic oligonucleotide
agaagttcctctgaacactattatctt

SEQ ID NO: 1129 - DNA, 27 bp, Artificial Sequence
  Synthetic oligonucleotide
gaagttcctctgaacactattatcttc

SEQ ID NO: 1130 - DNA, 27 bp, Artificial Sequence
  Synthetic oligonucleotide
aagttcctctgaacactattatcttca

SEQ ID NO: 1131 - DNA, 27 bp, Artificial Sequence
  Synthetic oligonucleotide
agttcctctgaacactattatcttcat

SEQ ID NO: 1132 - DNA, 27 bp, Artificial Sequence
  Synthetic oligonucleotide
gttcctctgaacactattatcttcatg

SEQ ID NO: 1133 - DNA, 27 bp, Artificial Sequence
  Synthetic oligonucleotide
ttcctctgaacactattatcttcatgg

SEQ ID NO: 1134 - DNA, 27 bp, Artificial Sequence
  Synthetic oligonucleotide
tcctctgaacactattatcttcatggg

SEQ ID NO: 1135 - DNA, 27 bp, Artificial Sequence
  Synthetic oligonucleotide
ctctgaacactattatcttcatgggca

SEQ ID NO: 1136 - DNA, 27 bp, Artificial Sequence
  Synthetic oligonucleotide
aacactattatcttcatgggcagagta

SEQ ID NO: 1137 - DNA, 27 bp, Artificial Sequence
  Synthetic oligonucleotide
acagaagtaaaaataaatacaaactac

SEQ ID NO: 1138 - DNA, 27 bp, Artificial Sequence
  Synthetic oligonucleotide
cagaagtaaaaataaatacaaactact

SEQ ID NO: 1139 - DNA, 27 bp, Artificial Sequence
  Synthetic oligonucleotide
gtggtgagatataagacataatcagaa

SEQ ID NO: 1140 - DNA, 27 bp, Artificial Sequence
  Synthetic oligonucleotide
caagcagctgatggaggtttttaaatt

SEQ ID NO: 1141 - DNA, 27 bp, Artificial Sequence
  Synthetic oligonucleotide
tgatggaggtttttaaatttgatacca

SEQ ID NO: 1142 - DNA, 27 bp, Artificial Sequence
  Synthetic oligonucleotide
agggaagttgcactgaacactattata

SEQ ID NO: 1143 - DNA, 27 bp, Artificial Sequence
  Synthetic oligonucleotide
gaagttgcactgaacactattatattc

SEQ ID NO: 1144 - DNA, 27 bp, Artificial Sequence
  Synthetic oligonucleotide
agttgcactgaacactattatattcat

SEQ ID NO: 1145 - DNA, 27 bp, Artificial Sequence
  Synthetic oligonucleotide
tactttggtgtttgtgaatagaagtaa

SEQ ID NO: 1146 - DNA, 27 bp, Artificial Sequence
  Synthetic oligonucleotide
ttggtgtttgtgaatagaagtaaaaat

SEQ ID NO: 1147 - DNA, 27 bp, Artificial Sequence
  Synthetic oligonucleotide
tggtgtttgtgaatagaagtaaaaata

SEQ ID NO: 1148 - DNA, 27 bp, Artificial Sequence
  Synthetic oligonucleotide
ggtgtttgtgaatagaagtaaaaataa

SEQ ID NO: 1149 - DNA, 27 bp, Artificial Sequence
  Synthetic oligonucleotide
gtgtttgtgaatagaagtaaaaataaa

SEQ ID NO: 1150 - DNA, 27 bp, Artificial Sequence
  Synthetic oligonucleotide
ttgtgaatagaagtaaaaataaatacg

SEQ ID NO: 1151 - DNA, 27 bp, Artificial Sequence
  Synthetic oligonucleotide
acaagaggtaaatatattactatttca

SEQ ID NO: 1152 - DNA, 27 bp, Artificial Sequence
  Synthetic oligonucleotide
agagaaatgcatttttatacaaaaaaa

SEQ ID NO: 1153 - RNA, 25 nt, Artificial Sequence
  Synthetic oligonucleotide
ccauguauuccaaugugauaggaac

SEQ ID NO: 1154 - RNA, 25 nt, Artificial Sequence
  Synthetic oligonucleotide
cauguauuccaaugugauaggaacu

SEQ ID NO: 1155 - RNA, 25 nt, Artificial Sequence
  Synthetic oligonucleotide
auguauuccaaugugauaggaacug

SEQ ID NO: 1156 - RNA, 25 nt, Artificial Sequence
  Synthetic oligonucleotide
uguauuccaaugugauaggaacugu

SEQ ID NO: 1157 - RNA, 25 nt, Artificial Sequence
  Synthetic oligonucleotide
guauuccaaugugauaggaacugua

SEQ ID NO: 1158 - RNA, 25 nt, Artificial Sequence
  Synthetic oligonucleotide
uauuccaaugugauaggaacuguaa

SEQ ID NO: 1159 - RNA, 25 nt, Artificial Sequence
  Synthetic oligonucleotide
auuccaaugugauaggaacuguaac

SEQ ID NO: 1160 - RNA, 25 nt, Artificial Sequence
  Synthetic oligonucleotide
cucuggaaaaaggaagguuuaucuu

SEQ ID NO: 1161 - RNA, 25 nt, Artificial Sequence
  Synthetic oligonucleotide
ucuggaaaaaggaagguuuaucuuu

SEQ ID NO: 1162 - RNA, 25 nt, Artificial Sequence
  Synthetic oligonucleotide
cuggaaaaaggaagguuuaucuuuu

SEQ ID NO: 1163 - RNA, 25 nt, Artificial Sequence
  Synthetic oligonucleotide
ggaaaaaggaagguuuaucuuuugu

SEQ ID NO: 1164 - RNA, 25 nt, Artificial Sequence
  Synthetic oligonucleotide
gaaaaaggaagguuuaucuuuuguc

SEQ ID NO: 1165 - RNA, 25 nt, Artificial Sequence
  Synthetic oligonucleotide
aaaaaggaagguuuaucuuuugucc

SEQ ID NO: 1166 - RNA, 25 nt, Artificial Sequence
  Synthetic oligonucleotide
ucccaugaaucccaugugcauuuac

SEQ ID NO: 1167 - RNA, 25 nt, Artificial Sequence
  Synthetic oligonucleotide
cccaugaaucccaugugcauuuacc

SEQ ID NO: 1168 - RNA, 25 nt, Artificial Sequence
  Synthetic oligonucleotide
augaaucccaugugcauuuaccgcu

SEQ ID NO: 1169 - RNA, 25 nt, Artificial Sequence
  Synthetic oligonucleotide
ugugcauuuaccgcuccccggagaa

SEQ ID NO: 1170 - RNA, 25 nt, Artificial Sequence
  Synthetic oligonucleotide
gucugggaacuguccaaggccaauu

SEQ ID NO: 1171 - RNA, 25 nt, Artificial Sequence
  Synthetic oligonucleotide
ucugggaacuguccaaggccaauuc

SEQ ID NO: 1172 - RNA, 25 nt, Artificial Sequence
  Synthetic oligonucleotide
cugggaacuguccaaggccaauucc

SEQ ID NO: 1173 - RNA, 25 nt, Artificial Sequence
  Synthetic oligonucleotide
ugggaacuguccaaggccaauuccc

SEQ ID NO: 1174 - RNA, 25 nt, Artificial Sequence
  Synthetic oligonucleotide
gggaacuguccaaggccaauucccg

SEQ ID NO: 1175 - RNA, 25 nt, Artificial Sequence
  Synthetic oligonucleotide
ggaacuguccaaggccaauucccgc

SEQ ID NO: 1176 - RNA, 25 nt, Artificial Sequence
  Synthetic oligonucleotide
gaacuguccaaggccaauucccgcu

SEQ ID NO: 1177 - RNA, 25 nt, Artificial Sequence
  Synthetic oligonucleotide
aacuguccaaggccaauucccgcuu

SEQ ID NO: 1178 - RNA, 25 nt, Artificial Sequence
  Synthetic oligonucleotide
auucccgcuuugcuaccacuuucua

SEQ ID NO: 1179 - RNA, 25 nt, Artificial Sequence
  Synthetic oligonucleotide
cccgcuuugcuaccacuuucuauca

SEQ ID NO: 1180 - RNA, 25 nt, Artificial Sequence
  Synthetic oligonucleotide
ccgcuuugcuaccacuuucuaucag

SEQ ID NO: 1181 - RNA, 25 nt, Artificial Sequence
  Synthetic oligonucleotide
cgcuuugcuaccacuuucuaucagc

SEQ ID NO: 1182 - RNA, 25 nt, Artificial Sequence
  Synthetic oligonucleotide
gcuuugcuaccacuuucuaucagca

SEQ ID NO: 1183 - RNA, 25 nt, Artificial Sequence
  Synthetic oligonucleotide
cuuugcuaccacuuucuaucagcac

SEQ ID NO: 1184 - RNA, 25 nt, Artificial Sequence
  Synthetic oligonucleotide
uuugcuaccacuuucuaucagcacc

SEQ ID NO: 1185 - RNA, 25 nt, Artificial Sequence
  Synthetic oligonucleotide
uugcuaccacuuucuaucagcaccu

SEQ ID NO: 1186 - RNA, 25 nt, Artificial Sequence
  Synthetic oligonucleotide
ugcuaccacuuucuaucagcaccug

SEQ ID NO: 1187 - RNA, 25 nt, Artificial Sequence
  Synthetic oligonucleotide
gcuaccacuuucuaucagcaccugg

SEQ ID NO: 1188 - RNA, 25 nt, Artificial Sequence
  Synthetic oligonucleotide
accuggcagauuccaagaaugacaa

SEQ ID NO: 1189 - RNA, 25 nt, Artificial Sequence
  Synthetic oligonucleotide
gauaacauuuuccugucaccccuga

SEQ ID NO: 1190 - RNA, 25 nt, Artificial Sequence
  Synthetic oligonucleotide
aacauuuuccugucaccccugagua

SEQ ID NO: 1191 - RNA, 25 nt, Artificial Sequence
  Synthetic oligonucleotide
cauuuuccugucaccccugaguauc

SEQ ID NO: 1192 - RNA, 25 nt, Artificial Sequence
  Synthetic oligonucleotide
gcuuuugcuaugaccaagcugggug

SEQ ID NO: 1193 - RNA, 25 nt, Artificial Sequence
  Synthetic oligonucleotide
cuuuugcuaugaccaagcugggugc

SEQ ID NO: 1194 - RNA, 25 nt, Artificial Sequence
  Synthetic oligonucleotide
uuuugcuaugaccaagcugggugcc

SEQ ID NO: 1195 - RNA, 25 nt, Artificial Sequence
  Synthetic oligonucleotide
uuugcuaugaccaagcugggugccu

SEQ ID NO: 1196 - RNA, 25 nt, Artificial Sequence
  Synthetic oligonucleotide
uugcuaugaccaagcugggugccug

SEQ ID NO: 1197 - RNA, 25 nt, Artificial Sequence
  Synthetic oligonucleotide
ugcuaugaccaagcugggugccugu

SEQ ID NO: 1198 - RNA, 25 nt, Artificial Sequence
  Synthetic oligonucleotide
gcuaugaccaagcugggugccugua

SEQ ID NO: 1199 - RNA, 25 nt, Artificial Sequence
  Synthetic oligonucleotide
cuaugaccaagcugggugccuguaa

SEQ ID NO: 1200 - RNA, 25 nt, Artificial Sequence
  Synthetic oligonucleotide
uaugaccaagcugggugccuguaau

SEQ ID NO: 1201 - RNA, 25 nt, Artificial Sequence
  Synthetic oligonucleotide
augaccaagcugggugccuguaaug

SEQ ID NO: 1202 - RNA, 25 nt, Artificial Sequence
  Synthetic oligonucleotide
ugaccaagcugggugccuguaauga

SEQ ID NO: 1203 - RNA, 25 nt, Artificial Sequence
  Synthetic oligonucleotide
gaccaagcugggugccuguaaugac

SEQ ID NO: 1204 - RNA, 25 nt, Artificial Sequence
  Synthetic oligonucleotide
accaagcugggugccuguaaugaca

SEQ ID NO: 1205 - RNA, 25 nt, Artificial Sequence
  Synthetic oligonucleotide
ccaagcugggugccuguaaugacac

SEQ ID NO: 1206 - RNA, 25 nt, Artificial Sequence
  Synthetic oligonucleotide
agcaacugauggagguauuuaaguu

SEQ ID NO: 1207 - RNA, 25 nt, Artificial Sequence
  Synthetic oligonucleotide
gcaacugauggagguauuuaaguuu

SEQ ID NO: 1208 - RNA, 25 nt, Artificial Sequence
  Synthetic oligonucleotide
caacugauggagguauuuaaguuug

SEQ ID NO: 1209 - RNA, 25 nt, Artificial Sequence
  Synthetic oligonucleotide
aacugauggagguauuuaaguuuga

SEQ ID NO: 1210 - RNA, 25 nt, Artificial Sequence
  Synthetic oligonucleotide
acugauggagguauuuaaguuugac

SEQ ID NO: 1211 - RNA, 25 nt, Artificial Sequence
  Synthetic oligonucleotide
cugauggagguauuuaaguuugaca

SEQ ID NO: 1212 - RNA, 25 nt, Artificial Sequence
  Synthetic oligonucleotide
ugauggagguauuuaaguuugacac

SEQ ID NO: 1213 - RNA, 25 nt, Artificial Sequence
  Synthetic oligonucleotide
gauggagguauuuaaguuugacacc

SEQ ID NO: 1214 - RNA, 25 nt, Artificial Sequence
  Synthetic oligonucleotide
auggagguauuuaaguuugacacca

SEQ ID NO: 1215 - RNA, 25 nt, Artificial Sequence
  Synthetic oligonucleotide
uggagguauuuaaguuugacaccau

SEQ ID NO: 1216 - RNA, 25 nt, Artificial Sequence
  Synthetic oligonucleotide
ggagguauuuaaguuugacaccaua

SEQ ID NO: 1217 - RNA, 25 nt, Artificial Sequence
  Synthetic oligonucleotide
gagguauuuaaguuugacaccauau

SEQ ID NO: 1218 - RNA, 25 nt, Artificial Sequence
  Synthetic oligonucleotide
agguauuuaaguuugacaccauauc

SEQ ID NO: 1219 - RNA, 25 nt, Artificial Sequence
  Synthetic oligonucleotide
gguauuuaaguuugacaccauaucu

SEQ ID NO: 1220 - RNA, 25 nt, Artificial Sequence
  Synthetic oligonucleotide
guauuuaaguuugacaccauaucug

SEQ ID NO: 1221 - RNA, 25 nt, Artificial Sequence
  Synthetic oligonucleotide
uauuuaaguuugacaccauaucuga

SEQ ID NO: 1222 - RNA, 25 nt, Artificial Sequence
  Synthetic oligonucleotide
auuuaaguuugacaccauaucugag

SEQ ID NO: 1223 - RNA, 25 nt, Artificial Sequence
  Synthetic oligonucleotide
uuuaaguuugacaccauaucugaga

SEQ ID NO: 1224 - RNA, 25 nt, Artificial Sequence
  Synthetic oligonucleotide
uuaaguuugacaccauaucugagaa

SEQ ID NO: 1225 - RNA, 25 nt, Artificial Sequence
  Synthetic oligonucleotide
uaaguuugacaccauaucugagaaa

SEQ ID NO: 1226 - RNA, 25 nt, Artificial Sequence
  Synthetic oligonucleotide
aaguuugacaccauaucugagaaaa

SEQ ID NO: 1227 - RNA, 25 nt, Artificial Sequence
  Synthetic oligonucleotide
aguuugacaccauaucugagaaaac

SEQ ID NO: 1228 - RNA, 25 nt, Artificial Sequence
  Synthetic oligonucleotide
guuugacaccauaucugagaaaaca

SEQ ID NO: 1229 - RNA, 25 nt, Artificial Sequence
  Synthetic oligonucleotide
uuugacaccauaucugagaaaacau

SEQ ID NO: 1230 - RNA, 25 nt, Artificial Sequence
  Synthetic oligonucleotide
uugacaccauaucugagaaaacauc

SEQ ID NO: 1231 - RNA, 25 nt, Artificial Sequence
  Synthetic oligonucleotide
ugacaccauaucugagaaaacaucu

SEQ ID NO: 1232 - RNA, 25 nt, Artificial Sequence
  Synthetic oligonucleotide
gacaccauaucugagaaaacaucug

SEQ ID NO: 1233 - RNA, 25 nt, Artificial Sequence
  Synthetic oligonucleotide
acaccauaucugagaaaacaucuga

SEQ ID NO: 1234 - RNA, 25 nt, Artificial Sequence
  Synthetic oligonucleotide
caccauaucugagaaaacaucugau

SEQ ID NO: 1235 - RNA, 25 nt, Artificial Sequence
  Synthetic oligonucleotide
accauaucugagaaaacaucugauc

SEQ ID NO: 1236 - RNA, 25 nt, Artificial Sequence
  Synthetic oligonucleotide
ccauaucugagaaaacaucugauca

SEQ ID NO: 1237 - RNA, 25 nt, Artificial Sequence
  Synthetic oligonucleotide
cauaucugagaaaacaucugaucag

SEQ ID NO: 1238 - RNA, 25 nt, Artificial Sequence
  Synthetic oligonucleotide
auaucugagaaaacaucugaucaga

SEQ ID NO: 1239 - RNA, 25 nt, Artificial Sequence
  Synthetic oligonucleotide
uaucugagaaaacaucugaucagau

SEQ ID NO: 1240 - RNA, 25 nt, Artificial Sequence
  Synthetic oligonucleotide
cugagaaaacaucugaucagaucca

SEQ ID NO: 1241 - RNA, 25 nt, Artificial Sequence
  Synthetic oligonucleotide
ugagaaaacaucugaucagauccac

SEQ ID NO: 1242 - RNA, 25 nt, Artificial Sequence
  Synthetic oligonucleotide
gagaaaacaucugaucagauccacu

SEQ ID NO: 1243 - RNA, 25 nt, Artificial Sequence
  Synthetic oligonucleotide
agaaaacaucugaucagauccacuu

SEQ ID NO: 1244 - RNA, 25 nt, Artificial Sequence
  Synthetic oligonucleotide
aucagauccacuucuucuuugccaa

SEQ ID NO: 1245 - RNA, 25 nt, Artificial Sequence
  Synthetic oligonucleotide
cagauccacuucuucuuugccaaac

SEQ ID NO: 1246 - RNA, 25 nt, Artificial Sequence
  Synthetic oligonucleotide
agauccacuucuucuuugccaaacu

SEQ ID NO: 1247 - RNA, 25 nt, Artificial Sequence
  Synthetic oligonucleotide
gauccacuucuucuuugccaaacug

SEQ ID NO: 1248 - RNA, 25 nt, Artificial Sequence
  Synthetic oligonucleotide
auccacuucuucuuugccaaacuga

SEQ ID NO: 1249 - RNA, 25 nt, Artificial Sequence
  Synthetic oligonucleotide
uccacuucuucuuugccaaacugaa

SEQ ID NO: 1250 - RNA, 25 nt, Artificial Sequence
  Synthetic oligonucleotide
ccacuucuucuuugccaaacugaac

SEQ ID NO: 1251 - RNA, 25 nt, Artificial Sequence
  Synthetic oligonucleotide
cacuucuucuuugccaaacugaacu

SEQ ID NO: 1252 - RNA, 25 nt, Artificial Sequence
  Synthetic oligonucleotide
acuucuucuuugccaaacugaacug

SEQ ID NO: 1253 - RNA, 25 nt, Artificial Sequence
  Synthetic oligonucleotide
cuucuucuuugccaaacugaacugc

SEQ ID NO: 1254 - RNA, 25 nt, Artificial Sequence
  Synthetic oligonucleotide
uucuucuuugccaaacugaacugcc

SEQ ID NO: 1255 - RNA, 25 nt, Artificial Sequence
  Synthetic oligonucleotide
ucuucuuugccaaacugaacugccg

SEQ ID NO: 1256 - RNA, 25 nt, Artificial Sequence
  Synthetic oligonucleotide
cuucuuugccaaacugaacugccga

SEQ ID NO: 1257 - RNA, 25 nt, Artificial Sequence
  Synthetic oligonucleotide
uucuuugccaaacugaacugccgac

SEQ ID NO: 1258 - RNA, 25 nt, Artificial Sequence
  Synthetic oligonucleotide
ucuuugccaaacugaacugccgacu

SEQ ID NO: 1259 - RNA, 25 nt, Artificial Sequence
  Synthetic oligonucleotide
cuuugccaaacugaacugccgacuc

SEQ ID NO: 1260 - RNA, 25 nt, Artificial Sequence
  Synthetic oligonucleotide
uuugccaaacugaacugccgacucu

SEQ ID NO: 1261 - RNA, 25 nt, Artificial Sequence
  Synthetic oligonucleotide
uugccaaacugaacugccgacucua

SEQ ID NO: 1262 - RNA, 25 nt, Artificial Sequence
  Synthetic oligonucleotide
ugccaaacugaacugccgacucuau

SEQ ID NO: 1263 - RNA, 25 nt, Artificial Sequence
  Synthetic oligonucleotide
gccaaacugaacugccgacucuauc

SEQ ID NO: 1264 - RNA, 25 nt, Artificial Sequence
  Synthetic oligonucleotide
ccaaacugaacugccgacucuaucg

SEQ ID NO: 1265 - RNA, 25 nt, Artificial Sequence
  Synthetic oligonucleotide
caaacugaacugccgacucuaucga

SEQ ID NO: 1266 - RNA, 25 nt, Artificial Sequence
  Synthetic oligonucleotide
aaacugaacugccgacucuaucgaa

SEQ ID NO: 1267 - RNA, 25 nt, Artificial Sequence
  Synthetic oligonucleotide
aacugaacugccgacucuaucgaaa

SEQ ID NO: 1268 - RNA, 25 nt, Artificial Sequence
  Synthetic oligonucleotide
acugaacugccgacucuaucgaaaa

SEQ ID NO: 1269 - RNA, 25 nt, Artificial Sequence
  Synthetic oligonucleotide
cugaacugccgacucuaucgaaaag

SEQ ID NO: 1270 - RNA, 25 nt, Artificial Sequence
  Synthetic oligonucleotide
ugaacugccgacucuaucgaaaagc

SEQ ID NO: 1271 - RNA, 25 nt, Artificial Sequence
  Synthetic oligonucleotide
gaacugccgacucuaucgaaaagcc

SEQ ID NO: 1272 - RNA, 25 nt, Artificial Sequence
  Synthetic oligonucleotide
aacugccgacucuaucgaaaagcca

SEQ ID NO: 1273 - RNA, 25 nt, Artificial Sequence
  Synthetic oligonucleotide
acugccgacucuaucgaaaagccaa

SEQ ID NO: 1274 - RNA, 25 nt, Artificial Sequence
  Synthetic oligonucleotide
cugccgacucuaucgaaaagccaac

SEQ ID NO: 1275 - RNA, 25 nt, Artificial Sequence
  Synthetic oligonucleotide
ugccgacucuaucgaaaagccaaca

SEQ ID NO: 1276 - RNA, 25 nt, Artificial Sequence
  Synthetic oligonucleotide
gccgacucuaucgaaaagccaacaa

SEQ ID NO: 1277 - RNA, 25 nt, Artificial Sequence
  Synthetic oligonucleotide
ccgacucuaucgaaaagccaacaaa

SEQ ID NO: 1278 - RNA, 25 nt, Artificial Sequence
  Synthetic oligonucleotide
cgacucuaucgaaaagccaacaaau

SEQ ID NO: 1279 - RNA, 25 nt, Artificial Sequence
  Synthetic oligonucleotide
gacucuaucgaaaagccaacaaauc

SEQ ID NO: 1280 - RNA, 25 nt, Artificial Sequence
  Synthetic oligonucleotide
acucuaucgaaaagccaacaaaucc

SEQ ID NO: 1281 - RNA, 25 nt, Artificial Sequence
  Synthetic oligonucleotide
cucuaucgaaaagccaacaaauccu

SEQ ID NO: 1282 - RNA, 25 nt, Artificial Sequence
  Synthetic oligonucleotide
ucuaucgaaaagccaacaaauccuc

SEQ ID NO: 1283 - RNA, 25 nt, Artificial Sequence
  Synthetic oligonucleotide
aaaagccaacaaauccuccaaguua

SEQ ID NO: 1284 - RNA, 25 nt, Artificial Sequence
  Synthetic oligonucleotide
aaagccaacaaauccuccaaguuag

SEQ ID NO: 1285 - RNA, 25 nt, Artificial Sequence
  Synthetic oligonucleotide
gccaacaaauccuccaaguuaguau

SEQ ID NO: 1286 - RNA, 25 nt, Artificial Sequence
  Synthetic oligonucleotide
ccaacaaauccuccaaguuaguauc

SEQ ID NO: 1287 - RNA, 25 nt, Artificial Sequence
  Synthetic oligonucleotide
caacaaauccuccaaguuaguauca

SEQ ID NO: 1288 - RNA, 25 nt, Artificial Sequence
  Synthetic oligonucleotide
aacaaauccuccaaguuaguaucag

SEQ ID NO: 1289 - RNA, 25 nt, Artificial Sequence
  Synthetic oligonucleotide
acaaauccuccaaguuaguaucagc

SEQ ID NO: 1290 - RNA, 25 nt, Artificial Sequence
  Synthetic oligonucleotide
caaauccuccaaguuaguaucagcc

SEQ ID NO: 1291 - RNA, 25 nt, Artificial Sequence
  Synthetic oligonucleotide
aguuaguaucagccaaucgccuuuu

SEQ ID NO: 1292 - RNA, 25 nt, Artificial Sequence
  Synthetic oligonucleotide
aguaucagccaaucgccuuuuugga

SEQ ID NO: 1293 - RNA, 25 nt, Artificial Sequence
  Synthetic oligonucleotide
cagccaaucgccuuuuuggagacaa

SEQ ID NO: 1294 - RNA, 25 nt, Artificial Sequence
  Synthetic oligonucleotide
agccaaucgccuuuuuggagacaaa

SEQ ID NO: 1295 - RNA, 25 nt, Artificial Sequence
  Synthetic oligonucleotide
gccaaucgccuuuuuggagacaaau

SEQ ID NO: 1296 - RNA, 25 nt, Artificial Sequence
  Synthetic oligonucleotide
aucgccuuuuuggagacaaaucccu

SEQ ID NO: 1297 - RNA, 25 nt, Artificial Sequence
  Synthetic oligonucleotide
cgccuuuuuggagacaaaucccuua

SEQ ID NO: 1298 - RNA, 25 nt, Artificial Sequence
  Synthetic oligonucleotide
gccuuuuuggagacaaaucccuuac

SEQ ID NO: 1299 - RNA, 25 nt, Artificial Sequence
  Synthetic oligonucleotide
ccuuuuuggagacaaaucccuuacc

SEQ ID NO: 1300 - RNA, 25 nt, Artificial Sequence
  Synthetic oligonucleotide
cuuuuuggagacaaaucccuuaccu

SEQ ID NO: 1301 - RNA, 25 nt, Artificial Sequence
  Synthetic oligonucleotide
uuuuuggagacaaaucccuuaccuu

SEQ ID NO: 1302 - RNA, 25 nt, Artificial Sequence
  Synthetic oligonucleotide
uggagacaaaucccuuaccuucaau

SEQ ID NO: 1303 - RNA, 25 nt, Artificial Sequence
  Synthetic oligonucleotide
ggagacaaaucccuuaccuucaaug

SEQ ID NO: 1304 - RNA, 25 nt, Artificial Sequence
  Synthetic oligonucleotide
gagacaaaucccuuaccuucaauga

SEQ ID NO: 1305 - RNA, 25 nt, Artificial Sequence
  Synthetic oligonucleotide
agacaaaucccuuaccuucaaugag

SEQ ID NO: 1306 - RNA, 25 nt, Artificial Sequence
  Synthetic oligonucleotide
gacaaaucccuuaccuucaaugaga

SEQ ID NO: 1307 - RNA, 25 nt, Artificial Sequence
  Synthetic oligonucleotide
acaaaucccuuaccuucaaugagac

SEQ ID NO: 1308 - RNA, 25 nt, Artificial Sequence
  Synthetic oligonucleotide
aaaucccuuaccuucaaugagaccu

SEQ ID NO: 1309 - RNA, 25 nt, Artificial Sequence
  Synthetic oligonucleotide
aaucccuuaccuucaaugagaccua

SEQ ID NO: 1310 - RNA, 25 nt, Artificial Sequence
  Synthetic oligonucleotide
aucccuuaccuucaaugagaccuac

SEQ ID NO: 1311 - RNA, 25 nt, Artificial Sequence
  Synthetic oligonucleotide
accuucaaugagaccuaccaggaca

SEQ ID NO: 1312 - RNA, 25 nt, Artificial Sequence
  Synthetic oligonucleotide
ucaaugagaccuaccaggacaucag

SEQ ID NO: 1313 - RNA, 25 nt, Artificial Sequence
  Synthetic oligonucleotide
caaugagaccuaccaggacaucagu

SEQ ID NO: 1314 - RNA, 25 nt, Artificial Sequence
  Synthetic oligonucleotide
aaugagaccuaccaggacaucagug

SEQ ID NO: 1315 - RNA, 25 nt, Artificial Sequence
  Synthetic oligonucleotide
ugagaccuaccaggacaucagugag

SEQ ID NO: 1316 - RNA, 25 nt, Artificial Sequence
  Synthetic oligonucleotide
agaccuaccaggacaucagugaguu

SEQ ID NO: 1317 - RNA, 25 nt, Artificial Sequence
  Synthetic oligonucleotide
cuaccaggacaucagugaguuggua

SEQ ID NO: 1318 - RNA, 25 nt, Artificial Sequence
  Synthetic oligonucleotide
uaccaggacaucagugaguugguau

SEQ ID NO: 1319 - RNA, 25 nt, Artificial Sequence
  Synthetic oligonucleotide
accaggacaucagugaguugguaua

SEQ ID NO: 1320 - RNA, 25 nt, Artificial Sequence
  Synthetic oligonucleotide
ccaggacaucagugaguugguauau

SEQ ID NO: 1321 - RNA, 25 nt, Artificial Sequence
  Synthetic oligonucleotide
caggacaucagugaguugguauaug

SEQ ID NO: 1322 - RNA, 25 nt, Artificial Sequence
  Synthetic oligonucleotide
aggacaucagugaguugguauaugg

SEQ ID NO: 1323 - RNA, 25 nt, Artificial Sequence
  Synthetic oligonucleotide
ggacaucagugaguugguauaugga

SEQ ID NO: 1324 - RNA, 25 nt, Artificial Sequence
  Synthetic oligonucleotide
gacaucagugaguugguauauggag

SEQ ID NO: 1325 - RNA, 25 nt, Artificial Sequence
  Synthetic oligonucleotide
acaucagugaguugguauauggagc

SEQ ID NO: 1326 - RNA, 25 nt, Artificial Sequence
  Synthetic oligonucleotide
uauggagccaagcuccagccccugg

SEQ ID NO: 1327 - RNA, 25 nt, Artificial Sequence
  Synthetic oligonucleotide
auggagccaagcuccagccccugga

SEQ ID NO: 1328 - RNA, 25 nt, Artificial Sequence
  Synthetic oligonucleotide
uggagccaagcuccagccccuggac

SEQ ID NO: 1329 - RNA, 25 nt, Artificial Sequence
  Synthetic oligonucleotide
ggagccaagcuccagccccuggacu

SEQ ID NO: 1330 - RNA, 25 nt, Artificial Sequence
  Synthetic oligonucleotide
gagccaagcuccagccccuggacuu

SEQ ID NO: 1331 - RNA, 25 nt, Artificial Sequence
  Synthetic oligonucleotide
agccaagcuccagccccuggacuuc

SEQ ID NO: 1332 - RNA, 25 nt, Artificial Sequence
  Synthetic oligonucleotide
gccaagcuccagccccuggacuuca

SEQ ID NO: 1333 - RNA, 25 nt, Artificial Sequence
  Synthetic oligonucleotide
ccaagcuccagccccuggacuucaa

SEQ ID NO: 1334 - RNA, 25 nt, Artificial Sequence
  Synthetic oligonucleotide
caagcuccagccccuggacuucaag

SEQ ID NO: 1335 - RNA, 25 nt, Artificial Sequence
  Synthetic oligonucleotide
aagcuccagccccuggacuucaagg

SEQ ID NO: 1336 - RNA, 25 nt, Artificial Sequence
  Synthetic oligonucleotide
agcuccagccccuggacuucaagga

SEQ ID NO: 1337 - RNA, 25 nt, Artificial Sequence
  Synthetic oligonucleotide
gcuccagccccuggacuucaaggaa

SEQ ID NO: 1338 - RNA, 25 nt, Artificial Sequence
  Synthetic oligonucleotide
cuccagccccuggacuucaaggaaa

SEQ ID NO: 1339 - RNA, 25 nt, Artificial Sequence
  Synthetic oligonucleotide
uccagccccuggacuucaaggaaaa

SEQ ID NO: 1340 - RNA, 25 nt, Artificial Sequence
  Synthetic oligonucleotide
ccagccccuggacuucaaggaaaau

SEQ ID NO: 1341 - RNA, 25 nt, Artificial Sequence
  Synthetic oligonucleotide
cagccccuggacuucaaggaaaaug

SEQ ID NO: 1342 - RNA, 25 nt, Artificial Sequence
  Synthetic oligonucleotide
agccccuggacuucaaggaaaaugc

SEQ ID NO: 1343 - RNA, 25 nt, Artificial Sequence
  Synthetic oligonucleotide
gccccuggacuucaaggaaaaugca

SEQ ID NO: 1344 - RNA, 25 nt, Artificial Sequence
  Synthetic oligonucleotide
uggacuucaaggaaaaugcagagca

SEQ ID NO: 1345 - RNA, 25 nt, Artificial Sequence
  Synthetic oligonucleotide
ggacuucaaggaaaaugcagagcaa

SEQ ID NO: 1346 - RNA, 25 nt, Artificial Sequence
  Synthetic oligonucleotide
gacuucaaggaaaaugcagagcaau

SEQ ID NO: 1347 - RNA, 25 nt, Artificial Sequence
  Synthetic oligonucleotide
acuucaaggaaaaugcagagcaauc

SEQ ID NO: 1348 - RNA, 25 nt, Artificial Sequence
  Synthetic oligonucleotide
uucaaggaaaaugcagagcaaucca

SEQ ID NO: 1349 - RNA, 25 nt, Artificial Sequence
  Synthetic oligonucleotide
ucaaggaaaaugcagagcaauccag

SEQ ID NO: 1350 - RNA, 25 nt, Artificial Sequence
  Synthetic oligonucleotide
caaggaaaaugcagagcaauccaga

SEQ ID NO: 1351 - RNA, 25 nt, Artificial Sequence
  Synthetic oligonucleotide
aaggaaaaugcagagcaauccagag

SEQ ID NO: 1352 - RNA, 25 nt, Artificial Sequence
  Synthetic oligonucleotide
caucaacaaauggguguccaauaag

SEQ ID NO: 1353 - RNA, 25 nt, Artificial Sequence
  Synthetic oligonucleotide
aucaacaaauggguguccaauaaga

SEQ ID NO: 1354 - RNA, 25 nt, Artificial Sequence
  Synthetic oligonucleotide
caaauggguguccaauaagaccgaa

SEQ ID NO: 1355 - RNA, 25 nt, Artificial Sequence
  Synthetic oligonucleotide
gagcucacuguucuggugcugguua

SEQ ID NO: 1356 - RNA, 25 nt, Artificial Sequence
  Synthetic oligonucleotide
gcucacuguucuggugcugguuaac

SEQ ID NO: 1357 - RNA, 25 nt, Artificial Sequence
  Synthetic oligonucleotide
cucacuguucuggugcugguuaaca

SEQ ID NO: 1358 - RNA, 25 nt, Artificial Sequence
  Synthetic oligonucleotide
ucacuguucuggugcugguuaacac

SEQ ID NO: 1359 - RNA, 25 nt, Artificial Sequence
  Synthetic oligonucleotide
cacuguucuggugcugguuaacacc

SEQ ID NO: 1360 - RNA, 25 nt, Artificial Sequence
  Synthetic oligonucleotide
acuguucuggugcugguuaacacca

SEQ ID NO: 1361 - RNA, 25 nt, Artificial Sequence
  Synthetic oligonucleotide
cuguucuggugcugguuaacaccau

SEQ ID NO: 1362 - RNA, 25 nt, Artificial Sequence
  Synthetic oligonucleotide
uguucuggugcugguuaacaccauu

SEQ ID NO: 1363 - RNA, 25 nt, Artificial Sequence
  Synthetic oligonucleotide
guucuggugcugguuaacaccauuu

SEQ ID NO: 1364 - RNA, 25 nt, Artificial Sequence
  Synthetic oligonucleotide
uucuggugcugguuaacaccauuua

SEQ ID NO: 1365 - RNA, 25 nt, Artificial Sequence
  Synthetic oligonucleotide
ucuggugcugguuaacaccauuuac

SEQ ID NO: 1366 - RNA, 25 nt, Artificial Sequence
  Synthetic oligonucleotide
cuggugcugguuaacaccauuuacu

SEQ ID NO: 1367 - RNA, 25 nt, Artificial Sequence
  Synthetic oligonucleotide
uggugcugguuaacaccauuuacuu

SEQ ID NO: 1368 - RNA, 25 nt, Artificial Sequence
  Synthetic oligonucleotide
ggugcugguuaacaccauuuacuuc

SEQ ID NO: 1369 - RNA, 25 nt, Artificial Sequence
  Synthetic oligonucleotide
gugcugguuaacaccauuuacuuca

SEQ ID NO: 1370 - RNA, 25 nt, Artificial Sequence
  Synthetic oligonucleotide
ugcugguuaacaccauuuacuucaa

SEQ ID NO: 1371 - RNA, 25 nt, Artificial Sequence
  Synthetic oligonucleotide
gcugguuaacaccauuuacuucaag

SEQ ID NO: 1372 - RNA, 25 nt, Artificial Sequence
  Synthetic oligonucleotide
cugguuaacaccauuuacuucaagg

SEQ ID NO: 1373 - RNA, 25 nt, Artificial Sequence
  Synthetic oligonucleotide
ugguuaacaccauuuacuucaaggg

SEQ ID NO: 1374 - RNA, 25 nt, Artificial Sequence
  Synthetic oligonucleotide
gguuaacaccauuuacuucaagggc

SEQ ID NO: 1375 - RNA, 25 nt, Artificial Sequence
  Synthetic oligonucleotide
guuaacaccauuuacuucaagggcc

SEQ ID NO: 1376 - RNA, 25 nt, Artificial Sequence
  Synthetic oligonucleotide
uuaacaccauuuacuucaagggccu

SEQ ID NO: 1377 - RNA, 25 nt, Artificial Sequence
  Synthetic oligonucleotide
uaacaccauuuacuucaagggccug

SEQ ID NO: 1378 - RNA, 25 nt, Artificial Sequence
  Synthetic oligonucleotide
aacaccauuuacuucaagggccugu

SEQ ID NO: 1379 - RNA, 25 nt, Artificial Sequence
  Synthetic oligonucleotide
acaccauuuacuucaagggccugug

SEQ ID NO: 1380 - RNA, 25 nt, Artificial Sequence
  Synthetic oligonucleotide
caccauuuacuucaagggccugugg

SEQ ID NO: 1381 - RNA, 25 nt, Artificial Sequence
  Synthetic oligonucleotide
accauuuacuucaagggccugugga

SEQ ID NO: 1382 - RNA, 25 nt, Artificial Sequence
  Synthetic oligonucleotide
ccauuuacuucaagggccuguggaa

SEQ ID NO: 1383 - RNA, 25 nt, Artificial Sequence
  Synthetic oligonucleotide
cauuuacuucaagggccuguggaag

SEQ ID NO: 1384 - RNA, 25 nt, Artificial Sequence
  Synthetic oligonucleotide
auuuacuucaagggccuguggaagu

SEQ ID NO: 1385 - RNA, 25 nt, Artificial Sequence
  Synthetic oligonucleotide
uuuacuucaagggccuguggaaguc

SEQ ID NO: 1386 - RNA, 25 nt, Artificial Sequence
  Synthetic oligonucleotide
uuacuucaagggccuguggaaguca

SEQ ID NO: 1387 - RNA, 25 nt, Artificial Sequence
  Synthetic oligonucleotide
uacuucaagggccuguggaagucaa

SEQ ID NO: 1388 - RNA, 25 nt, Artificial Sequence
  Synthetic oligonucleotide
acuucaagggccuguggaagucaaa

SEQ ID NO: 1389 - RNA, 25 nt, Artificial Sequence
  Synthetic oligonucleotide
cuucaagggccuguggaagucaaag

SEQ ID NO: 1390 - RNA, 25 nt, Artificial Sequence
  Synthetic oligonucleotide
uucaagggccuguggaagucaaagu

SEQ ID NO: 1391 - RNA, 25 nt, Artificial Sequence
  Synthetic oligonucleotide
ucaagggccuguggaagucaaaguu

SEQ ID NO: 1392 - RNA, 25 nt, Artificial Sequence
  Synthetic oligonucleotide
caagggccuguggaagucaaaguuc

SEQ ID NO: 1393 - RNA, 25 nt, Artificial Sequence
  Synthetic oligonucleotide
aagggccuguggaagucaaaguuca

SEQ ID NO: 1394 - RNA, 25 nt, Artificial Sequence
  Synthetic oligonucleotide
agggccuguggaagucaaaguucag

SEQ ID NO: 1395 - RNA, 25 nt, Artificial Sequence
  Synthetic oligonucleotide
gggccuguggaagucaaaguucagc

SEQ ID NO: 1396 - RNA, 25 nt, Artificial Sequence
  Synthetic oligonucleotide
ggccuguggaagucaaaguucagcc

SEQ ID NO: 1397 - RNA, 25 nt, Artificial Sequence
  Synthetic oligonucleotide
gccuguggaagucaaaguucagccc

SEQ ID NO: 1398 - RNA, 25 nt, Artificial Sequence
  Synthetic oligonucleotide
ccuguggaagucaaaguucagcccu

SEQ ID NO: 1399 - RNA, 25 nt, Artificial Sequence
  Synthetic oligonucleotide
cuguggaagucaaaguucagcccug

SEQ ID NO: 1400 - RNA, 25 nt, Artificial Sequence
  Synthetic oligonucleotide
uguggaagucaaaguucagcccuga

SEQ ID NO: 1401 - RNA, 25 nt, Artificial Sequence
  Synthetic oligonucleotide
guggaagucaaaguucagcccugag

SEQ ID NO: 1402 - RNA, 25 nt, Artificial Sequence
  Synthetic oligonucleotide
uggaagucaaaguucagcccugaga

SEQ ID NO: 1403 - RNA, 25 nt, Artificial Sequence
  Synthetic oligonucleotide
ggaagucaaaguucagcccugagaa

SEQ ID NO: 1404 - RNA, 25 nt, Artificial Sequence
  Synthetic oligonucleotide
gaagucaaaguucagcccugagaac

SEQ ID NO: 1405 - RNA, 25 nt, Artificial Sequence
  Synthetic oligonucleotide
aagucaaaguucagcccugagaaca

SEQ ID NO: 1406 - RNA, 25 nt, Artificial Sequence
  Synthetic oligonucleotide
agucaaaguucagcccugagaacac

SEQ ID NO: 1407 - RNA, 25 nt, Artificial Sequence
  Synthetic oligonucleotide
caaggcugauggagagucguguuca

SEQ ID NO: 1408 - RNA, 25 nt, Artificial Sequence
  Synthetic oligonucleotide
gauggagagucguguucagcaucua

SEQ ID NO: 1409 - RNA, 25 nt, Artificial Sequence
  Synthetic oligonucleotide
auggagagucguguucagcaucuau

SEQ ID NO: 1410 - RNA, 25 nt, Artificial Sequence
  Synthetic oligonucleotide
cuaugauguaccaggaaggcaaguu

SEQ ID NO: 1411 - RNA, 25 nt, Artificial Sequence
  Synthetic oligonucleotide
uaugauguaccaggaaggcaaguuc

SEQ ID NO: 1412 - RNA, 25 nt, Artificial Sequence
  Synthetic oligonucleotide
augauguaccaggaaggcaaguucc

SEQ ID NO: 1413 - RNA, 25 nt, Artificial Sequence
  Synthetic oligonucleotide
ugauguaccaggaaggcaaguuccg

SEQ ID NO: 1414 - RNA, 25 nt, Artificial Sequence
  Synthetic oligonucleotide
auguaccaggaaggcaaguuccguu

SEQ ID NO: 1415 - RNA, 25 nt, Artificial Sequence
  Synthetic oligonucleotide
ccaggugcuugaguugcccuucaaa

SEQ ID NO: 1416 - RNA, 25 nt, Artificial Sequence
  Synthetic oligonucleotide
ggugcuugaguugcccuucaaaggu

SEQ ID NO: 1417 - RNA, 25 nt, Artificial Sequence
  Synthetic oligonucleotide
gugcuugaguugcccuucaaaggug

SEQ ID NO: 1418 - RNA, 25 nt, Artificial Sequence
  Synthetic oligonucleotide
ugcuugaguugcccuucaaagguga

SEQ ID NO: 1419 - RNA, 25 nt, Artificial Sequence
  Synthetic oligonucleotide
ggugaugacaucaccaugguccuca

SEQ ID NO: 1420 - RNA, 25 nt, Artificial Sequence
  Synthetic oligonucleotide
gugaugacaucaccaugguccucau

SEQ ID NO: 1421 - RNA, 25 nt, Artificial Sequence
  Synthetic oligonucleotide
ugcccaagccugagaagagccuggc

SEQ ID NO: 1422 - RNA, 25 nt, Artificial Sequence
  Synthetic oligonucleotide
gcccaagccugagaagagccuggcc

SEQ ID NO: 1423 - RNA, 25 nt, Artificial Sequence
  Synthetic oligonucleotide
cccaagccugagaagagccuggcca

SEQ ID NO: 1424 - RNA, 25 nt, Artificial Sequence
  Synthetic oligonucleotide
ccaagccugagaagagccuggccaa

SEQ ID NO: 1425 - RNA, 25 nt, Artificial Sequence
  Synthetic oligonucleotide
caagccugagaagagccuggccaag

SEQ ID NO: 1426 - RNA, 25 nt, Artificial Sequence
  Synthetic oligonucleotide
aagccugagaagagccuggccaagg

SEQ ID NO: 1427 - RNA, 25 nt, Artificial Sequence
  Synthetic oligonucleotide
agccugagaagagccuggccaaggu

SEQ ID NO: 1428 - RNA, 25 nt, Artificial Sequence
  Synthetic oligonucleotide
gccugagaagagccuggccaaggua

SEQ ID NO: 1429 - RNA, 25 nt, Artificial Sequence
  Synthetic oligonucleotide
ccugagaagagccuggccaagguag

SEQ ID NO: 1430 - RNA, 25 nt, Artificial Sequence
  Synthetic oligonucleotide
cugagaagagccuggccaagguaga

SEQ ID NO: 1431 - RNA, 25 nt, Artificial Sequence
  Synthetic oligonucleotide
ugagaagagccuggccaagguagag

SEQ ID NO: 1432 - RNA, 25 nt, Artificial Sequence
  Synthetic oligonucleotide
gagaagagccuggccaagguagaga

SEQ ID NO: 1433 - RNA, 25 nt, Artificial Sequence
  Synthetic oligonucleotide
agaagagccuggccaagguagagaa

SEQ ID NO: 1434 - RNA, 25 nt, Artificial Sequence
  Synthetic oligonucleotide
gugguccacaugccccgcuuccgca

SEQ ID NO: 1435 - RNA, 25 nt, Artificial Sequence
  Synthetic oligonucleotide
ugguccacaugccccgcuuccgcau

SEQ ID NO: 1436 - RNA, 25 nt, Artificial Sequence
  Synthetic oligonucleotide
gguccacaugccccgcuuccgcauu

SEQ ID NO: 1437 - RNA, 25 nt, Artificial Sequence
  Synthetic oligonucleotide
guccacaugccccgcuuccgcauug

SEQ ID NO: 1438 - RNA, 25 nt, Artificial Sequence
  Synthetic oligonucleotide
uccacaugccccgcuuccgcauuga

SEQ ID NO: 1439 - RNA, 25 nt, Artificial Sequence
  Synthetic oligonucleotide
ccacaugccccgcuuccgcauugag

SEQ ID NO: 1440 - RNA, 25 nt, Artificial Sequence
  Synthetic oligonucleotide
cacaugccccgcuuccgcauugagg

SEQ ID NO: 1441 - RNA, 25 nt, Artificial Sequence
  Synthetic oligonucleotide
aguuugaaggagcagcugcaagaca

SEQ ID NO: 1442 - RNA, 25 nt, Artificial Sequence
  Synthetic oligonucleotide
guuugaaggagcagcugcaagacau

SEQ ID NO: 1443 - RNA, 25 nt, Artificial Sequence
  Synthetic oligonucleotide
ugaaggagcagcugcaagacauggg

SEQ ID NO: 1444 - RNA, 25 nt, Artificial Sequence
  Synthetic oligonucleotide
gaaggagcagcugcaagacaugggc

SEQ ID NO: 1445 - RNA, 25 nt, Artificial Sequence
  Synthetic oligonucleotide
aaggagcagcugcaagacaugggcc

SEQ ID NO: 1446 - RNA, 25 nt, Artificial Sequence
  Synthetic oligonucleotide
aggagcagcugcaagacaugggccu

SEQ ID NO: 1447 - RNA, 25 nt, Artificial Sequence
  Synthetic oligonucleotide
ggagcagcugcaagacaugggccuu

SEQ ID NO: 1448 - RNA, 25 nt, Artificial Sequence
  Synthetic oligonucleotide
gagcagcugcaagacaugggccuug

SEQ ID NO: 1449 - RNA, 25 nt, Artificial Sequence
  Synthetic oligonucleotide
agcagcugcaagacaugggccuugu

SEQ ID NO: 1450 - RNA, 25 nt, Artificial Sequence
  Synthetic oligonucleotide
gcagcugcaagacaugggccuuguc

SEQ ID NO: 1451 - RNA, 25 nt, Artificial Sequence
  Synthetic oligonucleotide
cagcugcaagacaugggccuugucg

SEQ ID NO: 1452 - RNA, 25 nt, Artificial Sequence
  Synthetic oligonucleotide
agcugcaagacaugggccuugucga

SEQ ID NO: 1453 - RNA, 25 nt, Artificial Sequence
  Synthetic oligonucleotide
uugucgaucuguucagcccugaaaa

SEQ ID NO: 1454 - RNA, 25 nt, Artificial Sequence
  Synthetic oligonucleotide
gucgaucuguucagcccugaaaagu

SEQ ID NO: 1455 - RNA, 25 nt, Artificial Sequence
  Synthetic oligonucleotide
ucgaucuguucagcccugaaaaguc

SEQ ID NO: 1456 - RNA, 25 nt, Artificial Sequence
  Synthetic oligonucleotide
gaucuguucagcccugaaaagucca

SEQ ID NO: 1457 - RNA, 25 nt, Artificial Sequence
  Synthetic oligonucleotide
cuguucagcccugaaaaguccaaac

SEQ ID NO: 1458 - RNA, 25 nt, Artificial Sequence
  Synthetic oligonucleotide
guucagcccugaaaaguccaaacuc

SEQ ID NO: 1459 - RNA, 25 nt, Artificial Sequence
  Synthetic oligonucleotide
aaaguccaaacucccagguauuguu

SEQ ID NO: 1460 - RNA, 25 nt, Artificial Sequence
  Synthetic oligonucleotide
aaguccaaacucccagguauuguug

SEQ ID NO: 1461 - RNA, 25 nt, Artificial Sequence
  Synthetic oligonucleotide
guccaaacucccagguauuguugca

SEQ ID NO: 1462 - RNA, 25 nt, Artificial Sequence
  Synthetic oligonucleotide
ccaaacucccagguauuguugcaga

SEQ ID NO: 1463 - RNA, 25 nt, Artificial Sequence
  Synthetic oligonucleotide
caaacucccagguauuguugcagaa

SEQ ID NO: 1464 - RNA, 25 nt, Artificial Sequence
  Synthetic oligonucleotide
aaacucccagguauuguugcagaag

SEQ ID NO: 1465 - RNA, 25 nt, Artificial Sequence
  Synthetic oligonucleotide
aacucccagguauuguugcagaagg

SEQ ID NO: 1466 - RNA, 25 nt, Artificial Sequence
  Synthetic oligonucleotide
cauaaggcauuucuugagguaaaug

SEQ ID NO: 1467 - RNA, 25 nt, Artificial Sequence
  Synthetic oligonucleotide
auaaggcauuucuugagguaaauga

SEQ ID NO: 1468 - RNA, 25 nt, Artificial Sequence
  Synthetic oligonucleotide
uaaggcauuucuugagguaaaugaa

SEQ ID NO: 1469 - RNA, 25 nt, Artificial Sequence
  Synthetic oligonucleotide
aaggcauuucuugagguaaaugaag

SEQ ID NO: 1470 - RNA, 25 nt, Artificial Sequence
  Synthetic oligonucleotide
aggcauuucuugagguaaaugaaga

SEQ ID NO: 1471 - RNA, 25 nt, Artificial Sequence
  Synthetic oligonucleotide
ggcauuucuugagguaaaugaagaa

SEQ ID NO: 1472 - RNA, 25 nt, Artificial Sequence
  Synthetic oligonucleotide
gcauuucuugagguaaaugaagaag

SEQ ID NO: 1473 - RNA, 25 nt, Artificial Sequence
  Synthetic oligonucleotide
cauuucuugagguaaaugaagaagg

SEQ ID NO: 1474 - RNA, 25 nt, Artificial Sequence
  Synthetic oligonucleotide
ugagguaaaugaagaaggcagugaa

SEQ ID NO: 1475 - RNA, 25 nt, Artificial Sequence
  Synthetic oligonucleotide
gagguaaaugaagaaggcagugaag

SEQ ID NO: 1476 - RNA, 25 nt, Artificial Sequence
  Synthetic oligonucleotide
agguaaaugaagaaggcagugaagc

SEQ ID NO: 1477 - RNA, 25 nt, Artificial Sequence
  Synthetic oligonucleotide
gguaaaugaagaaggcagugaagca

SEQ ID NO: 1478 - RNA, 25 nt, Artificial Sequence
  Synthetic oligonucleotide
guaaaugaagaaggcagugaagcag

SEQ ID NO: 1479 - RNA, 25 nt, Artificial Sequence
  Synthetic oligonucleotide
uaaaugaagaaggcagugaagcagc

SEQ ID NO: 1480 - RNA, 25 nt, Artificial Sequence
  Synthetic oligonucleotide
aaaugaagaaggcagugaagcagcu

SEQ ID NO: 1481 - RNA, 25 nt, Artificial Sequence
  Synthetic oligonucleotide
aagaaggcagugaagcagcugcaag

SEQ ID NO: 1482 - RNA, 25 nt, Artificial Sequence
  Synthetic oligonucleotide
aaggcagugaagcagcugcaaguac

SEQ ID NO: 1483 - RNA, 25 nt, Artificial Sequence
  Synthetic oligonucleotide
aggcagugaagcagcugcaaguacc

SEQ ID NO: 1484 - RNA, 25 nt, Artificial Sequence
  Synthetic oligonucleotide
aagcagcugcaaguaccgcuguugu

SEQ ID NO: 1485 - RNA, 25 nt, Artificial Sequence
  Synthetic oligonucleotide
aacaggccuuuccugguuuuuauaa

SEQ ID NO: 1486 - RNA, 25 nt, Artificial Sequence
  Synthetic oligonucleotide
acaggccuuuccugguuuuuauaag

SEQ ID NO: 1487 - RNA, 25 nt, Artificial Sequence
  Synthetic oligonucleotide
caggccuuuccugguuuuuauaaga

SEQ ID NO: 1488 - RNA, 25 nt, Artificial Sequence
  Synthetic oligonucleotide
aggccuuuccugguuuuuauaagag

SEQ ID NO: 1489 - RNA, 25 nt, Artificial Sequence
  Synthetic oligonucleotide
ggccuuuccugguuuuuauaagaga

SEQ ID NO: 1490 - RNA, 25 nt, Artificial Sequence
  Synthetic oligonucleotide
gccuuuccugguuuuuauaagagaa

SEQ ID NO: 1491 - RNA, 25 nt, Artificial Sequence
  Synthetic oligonucleotide
cuuuccugguuuuuauaagagaagu

SEQ ID NO: 1492 - RNA, 25 nt, Artificial Sequence
  Synthetic oligonucleotide
uuuccugguuuuuauaagagaaguu

SEQ ID NO: 1493 - RNA, 25 nt, Artificial Sequence
  Synthetic oligonucleotide
uuccugguuuuuauaagagaaguuc

SEQ ID NO: 1494 - RNA, 25 nt, Artificial Sequence
  Synthetic oligonucleotide
uccugguuuuuauaagagaaguucc

SEQ ID NO: 1495 - RNA, 25 nt, Artificial Sequence
  Synthetic oligonucleotide
ccugguuuuuauaagagaaguuccu

SEQ ID NO: 1496 - RNA, 25 nt, Artificial Sequence
  Synthetic oligonucleotide
cugguuuuuauaagagaaguuccuc

SEQ ID NO: 1497 - RNA, 25 nt, Artificial Sequence
  Synthetic oligonucleotide
ugguuuuuauaagagaaguuccucu

SEQ ID NO: 1498 - RNA, 25 nt, Artificial Sequence
  Synthetic oligonucleotide
gguuuuuauaagagaaguuccucug

SEQ ID NO: 1499 - RNA, 25 nt, Artificial Sequence
  Synthetic oligonucleotide
guuuuuauaagagaaguuccucuga

SEQ ID NO: 1500 - RNA, 25 nt, Artificial Sequence
  Synthetic oligonucleotide
uuuuuauaagagaaguuccucugaa

SEQ ID NO: 1501 - RNA, 25 nt, Artificial Sequence
  Synthetic oligonucleotide
uuuuauaagagaaguuccucugaac

SEQ ID NO: 1502 - RNA, 25 nt, Artificial Sequence
  Synthetic oligonucleotide
uuuauaagagaaguuccucugaaca

SEQ ID NO: 1503 - RNA, 25 nt, Artificial Sequence
  Synthetic oligonucleotide
uuauaagagaaguuccucugaacac

SEQ ID NO: 1504 - RNA, 25 nt, Artificial Sequence
  Synthetic oligonucleotide
uauaagagaaguuccucugaacacu

SEQ ID NO: 1505 - RNA, 25 nt, Artificial Sequence
  Synthetic oligonucleotide
auaagagaaguuccucugaacacua

SEQ ID NO: 1506 - RNA, 25 nt, Artificial Sequence
  Synthetic oligonucleotide
uaagagaaguuccucugaacacuau

SEQ ID NO: 1507 - RNA, 25 nt, Artificial Sequence
  Synthetic oligonucleotide
aagagaaguuccucugaacacuauu

SEQ ID NO: 1508 - RNA, 25 nt, Artificial Sequence
  Synthetic oligonucleotide
agagaaguuccucugaacacuauua

SEQ ID NO: 1509 - RNA, 25 nt, Artificial Sequence
  Synthetic oligonucleotide
gagaaguuccucugaacacuauuau

SEQ ID NO: 1510 - RNA, 25 nt, Artificial Sequence
  Synthetic oligonucleotide
agaaguuccucugaacacuauuauc

SEQ ID NO: 1511 - RNA, 25 nt, Artificial Sequence
  Synthetic oligonucleotide
gaaguuccucugaacacuauuaucu

SEQ ID NO: 1512 - RNA, 25 nt, Artificial Sequence
  Synthetic oligonucleotide
aaguuccucugaacacuauuaucuu

SEQ ID NO: 1513 - RNA, 25 nt, Artificial Sequence
  Synthetic oligonucleotide
aguuccucugaacacuauuaucuuc

SEQ ID NO: 1514 - RNA, 25 nt, Artificial Sequence
  Synthetic oligonucleotide
guuccucugaacacuauuaucuuca

SEQ ID NO: 1515 - RNA, 25 nt, Artificial Sequence
  Synthetic oligonucleotide
uuccucugaacacuauuaucuucau

SEQ ID NO: 1516 - RNA, 25 nt, Artificial Sequence
  Synthetic oligonucleotide
uccucugaacacuauuaucuucaug

SEQ ID NO: 1517 - RNA, 25 nt, Artificial Sequence
  Synthetic oligonucleotide
ccucugaacacuauuaucuucaugg

SEQ ID NO: 1518 - RNA, 25 nt, Artificial Sequence
  Synthetic oligonucleotide
cucugaacacuauuaucuucauggg

SEQ ID NO: 1519 - RNA, 25 nt, Artificial Sequence
  Synthetic oligonucleotide
cugaacacuauuaucuucaugggca

SEQ ID NO: 1520 - RNA, 25 nt, Artificial Sequence
  Synthetic oligonucleotide
cacuauuaucuucaugggcagagua

SEQ ID NO: 1521 - RNA, 25 nt, Artificial Sequence
  Synthetic oligonucleotide
agaaguaaaaauaaauacaaacuac

SEQ ID NO: 1522 - RNA, 25 nt, Artificial Sequence
  Synthetic oligonucleotide
gaaguaaaaauaaauacaaacuacu

SEQ ID NO: 1523 - RNA, 25 nt, Artificial Sequence
  Synthetic oligonucleotide
ggugagauauaagacauaaucagaa

SEQ ID NO: 1524 - RNA, 25 nt, Artificial Sequence
  Synthetic oligonucleotide
agcagcugauggagguuuuuaaauu

SEQ ID NO: 1525 - RNA, 25 nt, Artificial Sequence
  Synthetic oligonucleotide
auggagguuuuuaaauuugauacca

SEQ ID NO: 1526 - RNA, 25 nt, Artificial Sequence
  Synthetic oligonucleotide
ggaaguugcacugaacacuauuaua

SEQ ID NO: 1527 - RNA, 25 nt, Artificial Sequence
  Synthetic oligonucleotide
aguugcacugaacacuauuauauuc

SEQ ID NO: 1528 - RNA, 25 nt, Artificial Sequence
  Synthetic oligonucleotide
uugcacugaacacuauuauauucau

SEQ ID NO: 1529 - RNA, 25 nt, Artificial Sequence
  Synthetic oligonucleotide
cuuugguguuugugaauagaaguaa

SEQ ID NO: 1530 - RNA, 25 nt, Artificial Sequence
  Synthetic oligonucleotide
gguguuugugaauagaaguaaaaau

SEQ ID NO: 1531 - RNA, 25 nt, Artificial Sequence
  Synthetic oligonucleotide
guguuugugaauagaaguaaaaaua

SEQ ID NO: 1532 - RNA, 25 nt, Artificial Sequence
  Synthetic oligonucleotide
uguuugugaauagaaguaaaaauaa

SEQ ID NO: 1533 - RNA, 25 nt, Artificial Sequence
  Synthetic oligonucleotide
guuugugaauagaaguaaaaauaaa

SEQ ID NO: 1534 - RNA, 25 nt, Artificial Sequence
  Synthetic oligonucleotide
gugaauagaaguaaaaauaaauacg

SEQ ID NO: 1535 - RNA, 25 nt, Artificial Sequence
  Synthetic oligonucleotide
aagagguaaauauauuacuauuuca

SEQ ID NO: 1536 - RNA, 25 nt, Artificial Sequence
  Synthetic oligonucleotide
agaaaugcauuuuuauacaaaaaaa

SEQ ID NO: 1537 - RNA, 21 nt, Artificial Sequence
  Synthetic oligonucleotide
ggccauguauuccaaugugau

SEQ ID NO: 1538 - RNA, 21 nt, Artificial Sequence
  Synthetic oligonucleotide
gccauguauuccaaugugaua

SEQ ID NO: 1539 - RNA, 21 nt, Artificial Sequence
  Synthetic oligonucleotide
ccauguauuccaaugugauag

SEQ ID NO: 1540 - RNA, 21 nt, Artificial Sequence
  Synthetic oligonucleotide
cauguauuccaaugugauagg

SEQ ID NO: 1541 - RNA, 21 nt, Artificial Sequence
  Synthetic oligonucleotide
auguauuccaaugugauagga

SEQ ID NO: 1542 - RNA, 21 nt, Artificial Sequence
  Synthetic oligonucleotide
uguauuccaaugugauaggaa

SEQ ID NO: 1543 - RNA, 21 nt, Artificial Sequence
  Synthetic oligonucleotide
guauuccaaugugauaggaac

SEQ ID NO: 1544 - RNA, 21 nt, Artificial Sequence
  Synthetic oligonucleotide
accucuggaaaaaggaagguu

SEQ ID NO: 1545 - RNA, 21 nt, Artificial Sequence
  Synthetic oligonucleotide
ccucuggaaaaaggaagguuu

SEQ ID NO: 1546 - RNA, 21 nt, Artificial Sequence
  Synthetic oligonucleotide
cucuggaaaaaggaagguuua

SEQ ID NO: 1547 - RNA, 21 nt, Artificial Sequence
  Synthetic oligonucleotide
cuggaaaaaggaagguuuauc

SEQ ID NO: 1548 - RNA, 21 nt, Artificial Sequence
  Synthetic oligonucleotide
uggaaaaaggaagguuuaucu

SEQ ID NO: 1549 - RNA, 21 nt, Artificial Sequence
  Synthetic oligonucleotide
ggaaaaaggaagguuuaucuu

SEQ ID NO: 1550 - RNA, 21 nt, Artificial Sequence
  Synthetic oligonucleotide
auucccaugaaucccaugugc

SEQ ID NO: 1551 - RNA, 21 nt, Artificial Sequence
  Synthetic oligonucleotide
uucccaugaaucccaugugca

SEQ ID NO: 1552 - RNA, 21 nt, Artificial Sequence
  Synthetic oligonucleotide
ccaugaaucccaugugcauuu

SEQ ID NO: 1553 - RNA, 21 nt, Artificial Sequence
  Synthetic oligonucleotide
caugugcauuuaccgcucccc

SEQ ID NO: 1554 - RNA, 21 nt, Artificial Sequence
  Synthetic oligonucleotide
gugucugggaacuguccaagg

SEQ ID NO: 1555 - RNA, 21 nt, Artificial Sequence
  Synthetic oligonucleotide
ugucugggaacuguccaaggc

SEQ ID NO: 1556 - RNA, 21 nt, Artificial Sequence
  Synthetic oligonucleotide
gucugggaacuguccaaggcc

SEQ ID NO: 1557 - RNA, 21 nt, Artificial Sequence
  Synthetic oligonucleotide
ucugggaacuguccaaggcca

SEQ ID NO: 1558 - RNA, 21 nt, Artificial Sequence
  Synthetic oligonucleotide
cugggaacuguccaaggccaa

SEQ ID NO: 1559 - RNA, 21 nt, Artificial Sequence
  Synthetic oligonucleotide
ugggaacuguccaaggccaau

SEQ ID NO: 1560 - RNA, 21 nt, Artificial Sequence
  Synthetic oligonucleotide
gggaacuguccaaggccaauu

SEQ ID NO: 1561 - RNA, 21 nt, Artificial Sequence
  Synthetic oligonucleotide
ggaacuguccaaggccaauuc

SEQ ID NO: 1562 - RNA, 21 nt, Artificial Sequence
  Synthetic oligonucleotide
caauucccgcuuugcuaccac

SEQ ID NO: 1563 - RNA, 21 nt, Artificial Sequence
  Synthetic oligonucleotide
uucccgcuuugcuaccacuuu

SEQ ID NO: 1564 - RNA, 21 nt, Artificial Sequence
  Synthetic oligonucleotide
ucccgcuuugcuaccacuuuc

SEQ ID NO: 1565 - RNA, 21 nt, Artificial Sequence
  Synthetic oligonucleotide
cccgcuuugcuaccacuuucu

SEQ ID NO: 1566 - RNA, 21 nt, Artificial Sequence
  Synthetic oligonucleotide
ccgcuuugcuaccacuuucua

SEQ ID NO: 1567 - RNA, 21 nt, Artificial Sequence
  Synthetic oligonucleotide
cgcuuugcuaccacuuucuau

SEQ ID NO: 1568 - RNA, 21 nt, Artificial Sequence
  Synthetic oligonucleotide
gcuuugcuaccacuuucuauc

SEQ ID NO: 1569 - RNA, 21 nt, Artificial Sequence
  Synthetic oligonucleotide
cuuugcuaccacuuucuauca

SEQ ID NO: 1570 - RNA, 21 nt, Artificial Sequence
  Synthetic oligonucleotide
uuugcuaccacuuucuaucag

SEQ ID NO: 1571 - RNA, 21 nt, Artificial Sequence
  Synthetic oligonucleotide
uugcuaccacuuucuaucagc

SEQ ID NO: 1572 - RNA, 21 nt, Artificial Sequence
  Synthetic oligonucleotide
gcaccuggcagauuccaagaa

SEQ ID NO: 1573 - RNA, 21 nt, Artificial Sequence
  Synthetic oligonucleotide
augauaacauuuuccugucac

SEQ ID NO: 1574 - RNA, 21 nt, Artificial Sequence
  Synthetic oligonucleotide
auaacauuuuccugucacccc

SEQ ID NO: 1575 - RNA, 21 nt, Artificial Sequence
  Synthetic oligonucleotide
aacauuuuccugucaccccug

SEQ ID NO: 1576 - RNA, 21 nt, Artificial Sequence
  Synthetic oligonucleotide
cggcuuuugcuaugaccaagc

SEQ ID NO: 1577 - RNA, 21 nt, Artificial Sequence
  Synthetic oligonucleotide
ggcuuuugcuaugaccaagcu

SEQ ID NO: 1578 - RNA, 21 nt, Artificial Sequence
  Synthetic oligonucleotide
gcuuuugcuaugaccaagcug

SEQ ID NO: 1579 - RNA, 21 nt, Artificial Sequence
  Synthetic oligonucleotide
cuuuugcuaugaccaagcugg

SEQ ID NO: 1580 - RNA, 21 nt, Artificial Sequence
  Synthetic oligonucleotide
uuuugcuaugaccaagcuggg

SEQ ID NO: 1581 - RNA, 21 nt, Artificial Sequence
  Synthetic oligonucleotide
uuugcuaugaccaagcugggu

SEQ ID NO: 1582 - RNA, 21 nt, Artificial Sequence
  Synthetic oligonucleotide
uugcuaugaccaagcugggug

SEQ ID NO: 1583 - RNA, 21 nt, Artificial Sequence
  Synthetic oligonucleotide
ugcuaugaccaagcugggugc

SEQ ID NO: 1584 - RNA, 21 nt, Artificial Sequence
  Synthetic oligonucleotide
gcuaugaccaagcugggugcc

SEQ ID NO: 1585 - RNA, 21 nt, Artificial Sequence
  Synthetic oligonucleotide
cuaugaccaagcugggugccu

SEQ ID NO: 1586 - RNA, 21 nt, Artificial Sequence
  Synthetic oligonucleotide
uaugaccaagcugggugccug

SEQ ID NO: 1587 - RNA, 21 nt, Artificial Sequence
  Synthetic oligonucleotide
augaccaagcugggugccugu

SEQ ID NO: 1588 - RNA, 21 nt, Artificial Sequence
  Synthetic oligonucleotide
ugaccaagcugggugccugua

SEQ ID NO: 1589 - RNA, 21 nt, Artificial Sequence
  Synthetic oligonucleotide
gaccaagcugggugccuguaa

SEQ ID NO: 1590 - RNA, 21 nt, Artificial Sequence
  Synthetic oligonucleotide
ccagcaacugauggagguauu

SEQ ID NO: 1591 - RNA, 21 nt, Artificial Sequence
  Synthetic oligonucleotide
cagcaacugauggagguauuu

SEQ ID NO: 1592 - RNA, 21 nt, Artificial Sequence
  Synthetic oligonucleotide
agcaacugauggagguauuua

SEQ ID NO: 1593 - RNA, 21 nt, Artificial Sequence
  Synthetic oligonucleotide
gcaacugauggagguauuuaa

SEQ ID NO: 1594 - RNA, 21 nt, Artificial Sequence
  Synthetic oligonucleotide
caacugauggagguauuuaag

SEQ ID NO: 1595 - RNA, 21 nt, Artificial Sequence
  Synthetic oligonucleotide
aacugauggagguauuuaagu

SEQ ID NO: 1596 - RNA, 21 nt, Artificial Sequence
  Synthetic oligonucleotide
acugauggagguauuuaaguu

SEQ ID NO: 1597 - RNA, 21 nt, Artificial Sequence
  Synthetic oligonucleotide
cugauggagguauuuaaguuu

SEQ ID NO: 1598 - RNA, 21 nt, Artificial Sequence
  Synthetic oligonucleotide
ugauggagguauuuaaguuug

SEQ ID NO: 1599 - RNA, 21 nt, Artificial Sequence
  Synthetic oligonucleotide
gauggagguauuuaaguuuga

SEQ ID NO: 1600 - RNA, 21 nt, Artificial Sequence
  Synthetic oligonucleotide
auggagguauuuaaguuugac

SEQ ID NO: 1601 - RNA, 21 nt, Artificial Sequence
  Synthetic oligonucleotide
uggagguauuuaaguuugaca

SEQ ID NO: 1602 - RNA, 21 nt, Artificial Sequence
  Synthetic oligonucleotide
ggagguauuuaaguuugacac

SEQ ID NO: 1603 - RNA, 21 nt, Artificial Sequence
  Synthetic oligonucleotide
gagguauuuaaguuugacacc

SEQ ID NO: 1604 - RNA, 21 nt, Artificial Sequence
  Synthetic oligonucleotide
agguauuuaaguuugacacca

SEQ ID NO: 1605 - RNA, 21 nt, Artificial Sequence
  Synthetic oligonucleotide
gguauuuaaguuugacaccau

SEQ ID NO: 1606 - RNA, 21 nt, Artificial Sequence
  Synthetic oligonucleotide
guauuuaaguuugacaccaua

SEQ ID NO: 1607 - RNA, 21 nt, Artificial Sequence
  Synthetic oligonucleotide
uauuuaaguuugacaccauau

SEQ ID NO: 1608 - RNA, 21 nt, Artificial Sequence
  Synthetic oligonucleotide
auuuaaguuugacaccauauc

SEQ ID NO: 1609 - RNA, 21 nt, Artificial Sequence
  Synthetic oligonucleotide
uuuaaguuugacaccauaucu

SEQ ID NO: 1610 - RNA, 21 nt, Artificial Sequence
  Synthetic oligonucleotide
uuaaguuugacaccauaucug

SEQ ID NO: 1611 - RNA, 21 nt, Artificial Sequence
  Synthetic oligonucleotide
uaaguuugacaccauaucuga

SEQ ID NO: 1612 - RNA, 21 nt, Artificial Sequence
  Synthetic oligonucleotide
aaguuugacaccauaucugag

SEQ ID NO: 1613 - RNA, 21 nt, Artificial Sequence
  Synthetic oligonucleotide
aguuugacaccauaucugaga

SEQ ID NO: 1614 - RNA, 21 nt, Artificial Sequence
  Synthetic oligonucleotide
guuugacaccauaucugagaa

SEQ ID NO: 1615 - RNA, 21 nt, Artificial Sequence
  Synthetic oligonucleotide
uuugacaccauaucugagaaa

SEQ ID NO: 1616 - RNA, 21 nt, Artificial Sequence
  Synthetic oligonucleotide
uugacaccauaucugagaaaa

SEQ ID NO: 1617 - RNA, 21 nt, Artificial Sequence
  Synthetic oligonucleotide
ugacaccauaucugagaaaac

SEQ ID NO: 1618 - RNA, 21 nt, Artificial Sequence
  Synthetic oligonucleotide
gacaccauaucugagaaaaca

SEQ ID NO: 1619 - RNA, 21 nt, Artificial Sequence
  Synthetic oligonucleotide
acaccauaucugagaaaacau

SEQ ID NO: 1620 - RNA, 21 nt, Artificial Sequence
  Synthetic oligonucleotide
caccauaucugagaaaacauc

SEQ ID NO: 1621 - RNA, 21 nt, Artificial Sequence
  Synthetic oligonucleotide
accauaucugagaaaacaucu

SEQ ID NO: 1622 - RNA, 21 nt, Artificial Sequence
  Synthetic oligonucleotide
ccauaucugagaaaacaucug

SEQ ID NO: 1623 - RNA, 21 nt, Artificial Sequence
  Synthetic oligonucleotide
cauaucugagaaaacaucuga

SEQ ID NO: 1624 - RNA, 21 nt, Artificial Sequence
  Synthetic oligonucleotide
aucugagaaaacaucugauca

SEQ ID NO: 1625 - RNA, 21 nt, Artificial Sequence
  Synthetic oligonucleotide
ucugagaaaacaucugaucag

SEQ ID NO: 1626 - RNA, 21 nt, Artificial Sequence
  Synthetic oligonucleotide
cugagaaaacaucugaucaga

SEQ ID NO: 1627 - RNA, 21 nt, Artificial Sequence
  Synthetic oligonucleotide
ugagaaaacaucugaucagau

SEQ ID NO: 1628 - RNA, 21 nt, Artificial Sequence
  Synthetic oligonucleotide
ugaucagauccacuucuucuu

SEQ ID NO: 1629 - RNA, 21 nt, Artificial Sequence
  Synthetic oligonucleotide
aucagauccacuucuucuuug

SEQ ID NO: 1630 - RNA, 21 nt, Artificial Sequence
  Synthetic oligonucleotide
ucagauccacuucuucuuugc

SEQ ID NO: 1631 - RNA, 21 nt, Artificial Sequence
  Synthetic oligonucleotide
cagauccacuucuucuuugcc

SEQ ID NO: 1632 - RNA, 21 nt, Artificial Sequence
  Synthetic oligonucleotide
agauccacuucuucuuugcca

SEQ ID NO: 1633 - RNA, 21 nt, Artificial Sequence
  Synthetic oligonucleotide
gauccacuucuucuuugccaa

SEQ ID NO: 1634 - RNA, 21 nt, Artificial Sequence
  Synthetic oligonucleotide
auccacuucuucuuugccaaa

SEQ ID NO: 1635 - RNA, 21 nt, Artificial Sequence
  Synthetic oligonucleotide
uccacuucuucuuugccaaac

SEQ ID NO: 1636 - RNA, 21 nt, Artificial Sequence
  Synthetic oligonucleotide
ccacuucuucuuugccaaacu

SEQ ID NO: 1637 - RNA, 21 nt, Artificial Sequence
  Synthetic oligonucleotide
cacuucuucuuugccaaacug

SEQ ID NO: 1638 - RNA, 21 nt, Artificial Sequence
  Synthetic oligonucleotide
acuucuucuuugccaaacuga

SEQ ID NO: 1639 - RNA, 21 nt, Artificial Sequence
  Synthetic oligonucleotide
cuucuucuuugccaaacugaa

SEQ ID NO: 1640 - RNA, 21 nt, Artificial Sequence
  Synthetic oligonucleotide
uucuucuuugccaaacugaac

SEQ ID NO: 1641 - RNA, 21 nt, Artificial Sequence
  Synthetic oligonucleotide
ucuucuuugccaaacugaacu

SEQ ID NO: 1642 - RNA, 21 nt, Artificial Sequence
  Synthetic oligonucleotide
cuucuuugccaaacugaacug

SEQ ID NO: 1643 - RNA, 21 nt, Artificial Sequence
  Synthetic oligonucleotide
uucuuugccaaacugaacugc

SEQ ID NO: 1644 - RNA, 21 nt, Artificial Sequence
  Synthetic oligonucleotide
ucuuugccaaacugaacugcc

SEQ ID NO: 1645 - RNA, 21 nt, Artificial Sequence
  Synthetic oligonucleotide
cuuugccaaacugaacugccg

SEQ ID NO: 1646 - RNA, 21 nt, Artificial Sequence
  Synthetic oligonucleotide
uuugccaaacugaacugccga

SEQ ID NO: 1647 - RNA, 21 nt, Artificial Sequence
  Synthetic oligonucleotide
uugccaaacugaacugccgac

SEQ ID NO: 1648 - RNA, 21 nt, Artificial Sequence
  Synthetic oligonucleotide
ugccaaacugaacugccgacu

SEQ ID NO: 1649 - RNA, 21 nt, Artificial Sequence
  Synthetic oligonucleotide
gccaaacugaacugccgacuc

SEQ ID NO: 1650 - RNA, 21 nt, Artificial Sequence
  Synthetic oligonucleotide
ccaaacugaacugccgacucu

SEQ ID NO: 1651 - RNA, 21 nt, Artificial Sequence
  Synthetic oligonucleotide
caaacugaacugccgacucua

SEQ ID NO: 1652 - RNA, 21 nt, Artificial Sequence
  Synthetic oligonucleotide
aaacugaacugccgacucuau

SEQ ID NO: 1653 - RNA, 21 nt, Artificial Sequence
  Synthetic oligonucleotide
aacugaacugccgacucuauc

SEQ ID NO: 1654 - RNA, 21 nt, Artificial Sequence
  Synthetic oligonucleotide
acugaacugccgacucuaucg

SEQ ID NO: 1655 - RNA, 21 nt, Artificial Sequence
  Synthetic oligonucleotide
cugaacugccgacucuaucga

SEQ ID NO: 1656 - RNA, 21 nt, Artificial Sequence
  Synthetic oligonucleotide
ugaacugccgacucuaucgaa

SEQ ID NO: 1657 - RNA, 21 nt, Artificial Sequence
  Synthetic oligonucleotide
gaacugccgacucuaucgaaa

SEQ ID NO: 1658 - RNA, 21 nt, Artificial Sequence
  Synthetic oligonucleotide
aacugccgacucuaucgaaaa

SEQ ID NO: 1659 - RNA, 21 nt, Artificial Sequence
  Synthetic oligonucleotide
acugccgacucuaucgaaaag

SEQ ID NO: 1660 - RNA, 21 nt, Artificial Sequence
  Synthetic oligonucleotide
cugccgacucuaucgaaaagc

SEQ ID NO: 1661 - RNA, 21 nt, Artificial Sequence
  Synthetic oligonucleotide
ugccgacucuaucgaaaagcc

SEQ ID NO: 1662 - RNA, 21 nt, Artificial Sequence
  Synthetic oligonucleotide
gccgacucuaucgaaaagcca

SEQ ID NO: 1663 - RNA, 21 nt, Artificial Sequence
  Synthetic oligonucleotide
ccgacucuaucgaaaagccaa

SEQ ID NO: 1664 - RNA, 21 nt, Artificial Sequence
  Synthetic oligonucleotide
cgacucuaucgaaaagccaac

SEQ ID NO: 1665 - RNA, 21 nt, Artificial Sequence
  Synthetic oligonucleotide
gacucuaucgaaaagccaaca

SEQ ID NO: 1666 - RNA, 21 nt, Artificial Sequence
  Synthetic oligonucleotide
acucuaucgaaaagccaacaa

SEQ ID NO: 1667 - RNA, 21 nt, Artificial Sequence
  Synthetic oligonucleotide
cgaaaagccaacaaauccucc

SEQ ID NO: 1668 - RNA, 21 nt, Artificial Sequence
  Synthetic oligonucleotide
gaaaagccaacaaauccucca

SEQ ID NO: 1669 - RNA, 21 nt, Artificial Sequence
  Synthetic oligonucleotide
aagccaacaaauccuccaagu

SEQ ID NO: 1670 - RNA, 21 nt, Artificial Sequence
  Synthetic oligonucleotide
agccaacaaauccuccaaguu

SEQ ID NO: 1671 - RNA, 21 nt, Artificial Sequence
  Synthetic oligonucleotide
gccaacaaauccuccaaguua

SEQ ID NO: 1672 - RNA, 21 nt, Artificial Sequence
  Synthetic oligonucleotide
ccaacaaauccuccaaguuag

SEQ ID NO: 1673 - RNA, 21 nt, Artificial Sequence
  Synthetic oligonucleotide
caacaaauccuccaaguuagu

SEQ ID NO: 1674 - RNA, 21 nt, Artificial Sequence
  Synthetic oligonucleotide
aacaaauccuccaaguuagua

SEQ ID NO: 1675 - RNA, 21 nt, Artificial Sequence
  Synthetic oligonucleotide
caaguuaguaucagccaaucg

SEQ ID NO: 1676 - RNA, 21 nt, Artificial Sequence
  Synthetic oligonucleotide
uuaguaucagccaaucgccuu

SEQ ID NO: 1677 - RNA, 21 nt, Artificial Sequence
  Synthetic oligonucleotide
aucagccaaucgccuuuuugg

SEQ ID NO: 1678 - RNA, 21 nt, Artificial Sequence
  Synthetic oligonucleotide
ucagccaaucgccuuuuugga

SEQ ID NO: 1679 - RNA, 21 nt, Artificial Sequence
  Synthetic oligonucleotide
cagccaaucgccuuuuuggag

SEQ ID NO: 1680 - RNA, 21 nt, Artificial Sequence
  Synthetic oligonucleotide
caaucgccuuuuuggagacaa

SEQ ID NO: 1681 - RNA, 21 nt, Artificial Sequence
  Synthetic oligonucleotide
aucgccuuuuuggagacaaau

SEQ ID NO: 1682 - RNA, 21 nt, Artificial Sequence
  Synthetic oligonucleotide
ucgccuuuuuggagacaaauc

SEQ ID NO: 1683 - RNA, 21 nt, Artificial Sequence
  Synthetic oligonucleotide
cgccuuuuuggagacaaaucc

SEQ ID NO: 1684 - RNA, 21 nt, Artificial Sequence
  Synthetic oligonucleotide
gccuuuuuggagacaaauccc

SEQ ID NO: 1685 - RNA, 21 nt, Artificial Sequence
  Synthetic oligonucleotide
ccuuuuuggagacaaaucccu

SEQ ID NO: 1686 - RNA, 21 nt, Artificial Sequence
  Synthetic oligonucleotide
uuuggagacaaaucccuuacc

SEQ ID NO: 1687 - RNA, 21 nt, Artificial Sequence
  Synthetic oligonucleotide
uuggagacaaaucccuuaccu

SEQ ID NO: 1688 - RNA, 21 nt, Artificial Sequence
  Synthetic oligonucleotide
uggagacaaaucccuuaccuu

SEQ ID NO: 1689 - RNA, 21 nt, Artificial Sequence
  Synthetic oligonucleotide
ggagacaaaucccuuaccuuc

SEQ ID NO: 1690 - RNA, 21 nt, Artificial Sequence
  Synthetic oligonucleotide
gagacaaaucccuuaccuuca

SEQ ID NO: 1691 - RNA, 21 nt, Artificial Sequence
  Synthetic oligonucleotide
agacaaaucccuuaccuucaa

SEQ ID NO: 1692 - RNA, 21 nt, Artificial Sequence
  Synthetic oligonucleotide
acaaaucccuuaccuucaaug

SEQ ID NO: 1693 - RNA, 21 nt, Artificial Sequence
  Synthetic oligonucleotide
caaaucccuuaccuucaauga

SEQ ID NO: 1694 - RNA, 21 nt, Artificial Sequence
  Synthetic oligonucleotide
aaaucccuuaccuucaaugag

SEQ ID NO: 1695 - RNA, 21 nt, Artificial Sequence
  Synthetic oligonucleotide
uuaccuucaaugagaccuacc

SEQ ID NO: 1696 - RNA, 21 nt, Artificial Sequence
  Synthetic oligonucleotide
cuucaaugagaccuaccagga

SEQ ID NO: 1697 - RNA, 21 nt, Artificial Sequence
  Synthetic oligonucleotide
uucaaugagaccuaccaggac

SEQ ID NO: 1698 - RNA, 21 nt, Artificial Sequence
  Synthetic oligonucleotide
ucaaugagaccuaccaggaca

SEQ ID NO: 1699 - RNA, 21 nt, Artificial Sequence
  Synthetic oligonucleotide
aaugagaccuaccaggacauc

SEQ ID NO: 1700 - RNA, 21 nt, Artificial Sequence
  Synthetic oligonucleotide
ugagaccuaccaggacaucag

SEQ ID NO: 1701 - RNA, 21 nt, Artificial Sequence
  Synthetic oligonucleotide
accuaccaggacaucagugag

SEQ ID NO: 1702 - RNA, 21 nt, Artificial Sequence
  Synthetic oligonucleotide
ccuaccaggacaucagugagu

SEQ ID NO: 1703 - RNA, 21 nt, Artificial Sequence
  Synthetic oligonucleotide
cuaccaggacaucagugaguu

SEQ ID NO: 1704 - RNA, 21 nt, Artificial Sequence
  Synthetic oligonucleotide
uaccaggacaucagugaguug

SEQ ID NO: 1705 - RNA, 21 nt, Artificial Sequence
  Synthetic oligonucleotide
accaggacaucagugaguugg

SEQ ID NO: 1706 - RNA, 21 nt, Artificial Sequence
  Synthetic oligonucleotide
ccaggacaucagugaguuggu

SEQ ID NO: 1707 - RNA, 21 nt, Artificial Sequence
  Synthetic oligonucleotide
caggacaucagugaguuggua

SEQ ID NO: 1708 - RNA, 21 nt, Artificial Sequence
  Synthetic oligonucleotide
aggacaucagugaguugguau

SEQ ID NO: 1709 - RNA, 21 nt, Artificial Sequence
  Synthetic oligonucleotide
ggacaucagugaguugguaua

SEQ ID NO: 1710 - RNA, 21 nt, Artificial Sequence
  Synthetic oligonucleotide
uauauggagccaagcuccagc

SEQ ID NO: 1711 - RNA, 21 nt, Artificial Sequence
  Synthetic oligonucleotide
auauggagccaagcuccagcc

SEQ ID NO: 1712 - RNA, 21 nt, Artificial Sequence
  Synthetic oligonucleotide
uauggagccaagcuccagccc

SEQ ID NO: 1713 - RNA, 21 nt, Artificial Sequence
  Synthetic oligonucleotide
auggagccaagcuccagcccc

SEQ ID NO: 1714 - RNA, 21 nt, Artificial Sequence
  Synthetic oligonucleotide
uggagccaagcuccagccccu

SEQ ID NO: 1715 - RNA, 21 nt, Artificial Sequence
  Synthetic oligonucleotide
ggagccaagcuccagccccug

SEQ ID NO: 1716 - RNA, 21 nt, Artificial Sequence
  Synthetic oligonucleotide
gagccaagcuccagccccugg

SEQ ID NO: 1717 - RNA, 21 nt, Artificial Sequence
  Synthetic oligonucleotide
agccaagcuccagccccugga

SEQ ID NO: 1718 - RNA, 21 nt, Artificial Sequence
  Synthetic oligonucleotide
gccaagcuccagccccuggac

SEQ ID NO: 1719 - RNA, 21 nt, Artificial Sequence
  Synthetic oligonucleotide
ccaagcuccagccccuggacu

SEQ ID NO: 1720 - RNA, 21 nt, Artificial Sequence
  Synthetic oligonucleotide
caagcuccagccccuggacuu

SEQ ID NO: 1721 - RNA, 21 nt, Artificial Sequence
  Synthetic oligonucleotide
aagcuccagccccuggacuuc

SEQ ID NO: 1722 - RNA, 21 nt, Artificial Sequence
  Synthetic oligonucleotide
agcuccagccccuggacuuca

SEQ ID NO: 1723 - RNA, 21 nt, Artificial Sequence
  Synthetic oligonucleotide
gcuccagccccuggacuucaa

SEQ ID NO: 1724 - RNA, 21 nt, Artificial Sequence
  Synthetic oligonucleotide
cuccagccccuggacuucaag

SEQ ID NO: 1725 - RNA, 21 nt, Artificial Sequence
  Synthetic oligonucleotide
uccagccccuggacuucaagg

SEQ ID NO: 1726 - RNA, 21 nt, Artificial Sequence
  Synthetic oligonucleotide
ccagccccuggacuucaagga

SEQ ID NO: 1727 - RNA, 21 nt, Artificial Sequence
  Synthetic oligonucleotide
cagccccuggacuucaaggaa

SEQ ID NO: 1728 - RNA, 21 nt, Artificial Sequence
  Synthetic oligonucleotide
ccuggacuucaaggaaaaugc

SEQ ID NO: 1729 - RNA, 21 nt, Artificial Sequence
  Synthetic oligonucleotide
cuggacuucaaggaaaaugca

SEQ ID NO: 1730 - RNA, 21 nt, Artificial Sequence
  Synthetic oligonucleotide
uggacuucaaggaaaaugcag

SEQ ID NO: 1731 - RNA, 21 nt, Artificial Sequence
  Synthetic oligonucleotide
ggacuucaaggaaaaugcaga

SEQ ID NO: 1732 - RNA, 21 nt, Artificial Sequence
  Synthetic oligonucleotide
acuucaaggaaaaugcagagc

SEQ ID NO: 1733 - RNA, 21 nt, Artificial Sequence
  Synthetic oligonucleotide
cuucaaggaaaaugcagagca

SEQ ID NO: 1734 - RNA, 21 nt, Artificial Sequence
  Synthetic oligonucleotide
uucaaggaaaaugcagagcaa

SEQ ID NO: 1735 - RNA, 21 nt, Artificial Sequence
  Synthetic oligonucleotide
ucaaggaaaaugcagagcaau

SEQ ID NO: 1736 - RNA, 21 nt, Artificial Sequence
  Synthetic oligonucleotide
gccaucaacaaaugggugucc

SEQ ID NO: 1737 - RNA, 21 nt, Artificial Sequence
  Synthetic oligonucleotide
ccaucaacaaaugggugucca

SEQ ID NO: 1738 - RNA, 21 nt, Artificial Sequence
  Synthetic oligonucleotide
aacaaauggguguccaauaag

SEQ ID NO: 1739 - RNA, 21 nt, Artificial Sequence
  Synthetic oligonucleotide
augagcucacuguucuggugc

SEQ ID NO: 1740 - RNA, 21 nt, Artificial Sequence
  Synthetic oligonucleotide
gagcucacuguucuggugcug

SEQ ID NO: 1741 - RNA, 21 nt, Artificial Sequence
  Synthetic oligonucleotide
agcucacuguucuggugcugg

SEQ ID NO: 1742 - RNA, 21 nt, Artificial Sequence
  Synthetic oligonucleotide
gcucacuguucuggugcuggu

SEQ ID NO: 1743 - RNA, 21 nt, Artificial Sequence
  Synthetic oligonucleotide
cucacuguucuggugcugguu

SEQ ID NO: 1744 - RNA, 21 nt, Artificial Sequence
  Synthetic oligonucleotide
ucacuguucuggugcugguua

SEQ ID NO: 1745 - RNA, 21 nt, Artificial Sequence
  Synthetic oligonucleotide
cacuguucuggugcugguuaa

SEQ ID NO: 1746 - RNA, 21 nt, Artificial Sequence
  Synthetic oligonucleotide
acuguucuggugcugguuaac

SEQ ID NO: 1747 - RNA, 21 nt, Artificial Sequence
  Synthetic oligonucleotide
cuguucuggugcugguuaaca

SEQ ID NO: 1748 - RNA, 21 nt, Artificial Sequence
  Synthetic oligonucleotide
uguucuggugcugguuaacac

SEQ ID NO: 1749 - RNA, 21 nt, Artificial Sequence
  Synthetic oligonucleotide
guucuggugcugguuaacacc

SEQ ID NO: 1750 - RNA, 21 nt, Artificial Sequence
  Synthetic oligonucleotide
uucuggugcugguuaacacca

SEQ ID NO: 1751 - RNA, 21 nt, Artificial Sequence
  Synthetic oligonucleotide
ucuggugcugguuaacaccau

SEQ ID NO: 1752 - RNA, 21 nt, Artificial Sequence
  Synthetic oligonucleotide
cuggugcugguuaacaccauu

SEQ ID NO: 1753 - RNA, 21 nt, Artificial Sequence
  Synthetic oligonucleotide
uggugcugguuaacaccauuu

SEQ ID NO: 1754 - RNA, 21 nt, Artificial Sequence
  Synthetic oligonucleotide
ggugcugguuaacaccauuua

SEQ ID NO: 1755 - RNA, 21 nt, Artificial Sequence
  Synthetic oligonucleotide
gugcugguuaacaccauuuac

SEQ ID NO: 1756 - RNA, 21 nt, Artificial Sequence
  Synthetic oligonucleotide
ugcugguuaacaccauuuacu

SEQ ID NO: 1757 - RNA, 21 nt, Artificial Sequence
  Synthetic oligonucleotide
gcugguuaacaccauuuacuu

SEQ ID NO: 1758 - RNA, 21 nt, Artificial Sequence
  Synthetic oligonucleotide
cugguuaacaccauuuacuuc

SEQ ID NO: 1759 - RNA, 21 nt, Artificial Sequence
  Synthetic oligonucleotide
ugguuaacaccauuuacuuca

SEQ ID NO: 1760 - RNA, 21 nt, Artificial Sequence
  Synthetic oligonucleotide
gguuaacaccauuuacuucaa

SEQ ID NO: 1761 - RNA, 21 nt, Artificial Sequence
  Synthetic oligonucleotide
guuaacaccauuuacuucaag

SEQ ID NO: 1762 - RNA, 21 nt, Artificial Sequence
  Synthetic oligonucleotide
uuaacaccauuuacuucaagg

SEQ ID NO: 1763 - RNA, 21 nt, Artificial Sequence
  Synthetic oligonucleotide
uaacaccauuuacuucaaggg

SEQ ID NO: 1764 - RNA, 21 nt, Artificial Sequence
  Synthetic oligonucleotide
aacaccauuuacuucaagggc

SEQ ID NO: 1765 - RNA, 21 nt, Artificial Sequence
  Synthetic oligonucleotide
acaccauuuacuucaagggcc

SEQ ID NO: 1766 - RNA, 21 nt, Artificial Sequence
  Synthetic oligonucleotide
caccauuuacuucaagggccu

SEQ ID NO: 1767 - RNA, 21 nt, Artificial Sequence
  Synthetic oligonucleotide
accauuuacuucaagggccug

SEQ ID NO: 1768 - RNA, 21 nt, Artificial Sequence
  Synthetic oligonucleotide
ccauuuacuucaagggccugu

SEQ ID NO: 1769 - RNA, 21 nt, Artificial Sequence
  Synthetic oligonucleotide
cauuuacuucaagggccugug

SEQ ID NO: 1770 - RNA, 21 nt, Artificial Sequence
  Synthetic oligonucleotide
auuuacuucaagggccugugg

SEQ ID NO: 1771 - RNA, 21 nt, Artificial Sequence
  Synthetic oligonucleotide
uuuacuucaagggccugugga

SEQ ID NO: 1772 - RNA, 21 nt, Artificial Sequence
  Synthetic oligonucleotide
uuacuucaagggccuguggaa

SEQ ID NO: 1773 - RNA, 21 nt, Artificial Sequence
  Synthetic oligonucleotide
uacuucaagggccuguggaag

SEQ ID NO: 1774 - RNA, 21 nt, Artificial Sequence
  Synthetic oligonucleotide
acuucaagggccuguggaagu

SEQ ID NO: 1775 - RNA, 21 nt, Artificial Sequence
  Synthetic oligonucleotide
cuucaagggccuguggaaguc

SEQ ID NO: 1776 - RNA, 21 nt, Artificial Sequence
  Synthetic oligonucleotide
uucaagggccuguggaaguca

SEQ ID NO: 1777 - RNA, 21 nt, Artificial Sequence
  Synthetic oligonucleotide
ucaagggccuguggaagucaa

SEQ ID NO: 1778 - RNA, 21 nt, Artificial Sequence
  Synthetic oligonucleotide
caagggccuguggaagucaaa

SEQ ID NO: 1779 - RNA, 21 nt, Artificial Sequence
  Synthetic oligonucleotide
aagggccuguggaagucaaag

SEQ ID NO: 1780 - RNA, 21 nt, Artificial Sequence
  Synthetic oligonucleotide
agggccuguggaagucaaagu

SEQ ID NO: 1781 - RNA, 21 nt, Artificial Sequence
  Synthetic oligonucleotide
gggccuguggaagucaaaguu

SEQ ID NO: 1782 - RNA, 21 nt, Artificial Sequence
  Synthetic oligonucleotide
ggccuguggaagucaaaguuc

SEQ ID NO: 1783 - RNA, 21 nt, Artificial Sequence
  Synthetic oligonucleotide
gccuguggaagucaaaguuca

SEQ ID NO: 1784 - RNA, 21 nt, Artificial Sequence
  Synthetic oligonucleotide
ccuguggaagucaaaguucag

SEQ ID NO: 1785 - RNA, 21 nt, Artificial Sequence
  Synthetic oligonucleotide
cuguggaagucaaaguucagc

SEQ ID NO: 1786 - RNA, 21 nt, Artificial Sequence
  Synthetic oligonucleotide
uguggaagucaaaguucagcc

SEQ ID NO: 1787 - RNA, 21 nt, Artificial Sequence
  Synthetic oligonucleotide
guggaagucaaaguucagccc

SEQ ID NO: 1788 - RNA, 21 nt, Artificial Sequence
  Synthetic oligonucleotide
uggaagucaaaguucagcccu

SEQ ID NO: 1789 - RNA, 21 nt, Artificial Sequence
  Synthetic oligonucleotide
ggaagucaaaguucagcccug

SEQ ID NO: 1790 - RNA, 21 nt, Artificial Sequence
  Synthetic oligonucleotide
gaagucaaaguucagcccuga

SEQ ID NO: 1791 - RNA, 21 nt, Artificial Sequence
  Synthetic oligonucleotide
uacaaggcugauggagagucg

SEQ ID NO: 1792 - RNA, 21 nt, Artificial Sequence
  Synthetic oligonucleotide
cugauggagagucguguucag

SEQ ID NO: 1793 - RNA, 21 nt, Artificial Sequence
  Synthetic oligonucleotide
ugauggagagucguguucagc

SEQ ID NO: 1794 - RNA, 21 nt, Artificial Sequence
  Synthetic oligonucleotide
aucuaugauguaccaggaagg

SEQ ID NO: 1795 - RNA, 21 nt, Artificial Sequence
  Synthetic oligonucleotide
ucuaugauguaccaggaaggc

SEQ ID NO: 1796 - RNA, 21 nt, Artificial Sequence
  Synthetic oligonucleotide
cuaugauguaccaggaaggca

SEQ ID NO: 1797 - RNA, 21 nt, Artificial Sequence
  Synthetic oligonucleotide
uaugauguaccaggaaggcaa

SEQ ID NO: 1798 - RNA, 21 nt, Artificial Sequence
  Synthetic oligonucleotide
ugauguaccaggaaggcaagu

SEQ ID NO: 1799 - RNA, 21 nt, Artificial Sequence
  Synthetic oligonucleotide
acccaggugcuugaguugccc

SEQ ID NO: 1800 - RNA, 21 nt, Artificial Sequence
  Synthetic oligonucleotide
caggugcuugaguugcccuuc

SEQ ID NO: 1801 - RNA, 21 nt, Artificial Sequence
  Synthetic oligonucleotide
aggugcuugaguugcccuuca

SEQ ID NO: 1802 - RNA, 21 nt, Artificial Sequence
  Synthetic oligonucleotide
ggugcuugaguugcccuucaa

SEQ ID NO: 1803 - RNA, 21 nt, Artificial Sequence
  Synthetic oligonucleotide
aaggugaugacaucaccaugg

SEQ ID NO: 1804 - RNA, 21 nt, Artificial Sequence
  Synthetic oligonucleotide
aggugaugacaucaccauggu

SEQ ID NO: 1805 - RNA, 21 nt, Artificial Sequence
  Synthetic oligonucleotide
cuugcccaagccugagaagag

SEQ ID NO: 1806 - RNA, 21 nt, Artificial Sequence
  Synthetic oligonucleotide
uugcccaagccugagaagagc

SEQ ID NO: 1807 - RNA, 21 nt, Artificial Sequence
  Synthetic oligonucleotide
ugcccaagccugagaagagcc

SEQ ID NO: 1808 - RNA, 21 nt, Artificial Sequence
  Synthetic oligonucleotide
gcccaagccugagaagagccu

SEQ ID NO: 1809 - RNA, 21 nt, Artificial Sequence
  Synthetic oligonucleotide
cccaagccugagaagagccug

SEQ ID NO: 1810 - RNA, 21 nt, Artificial Sequence
  Synthetic oligonucleotide
ccaagccugagaagagccugg

SEQ ID NO: 1811 - RNA, 21 nt, Artificial Sequence
  Synthetic oligonucleotide
caagccugagaagagccuggc

SEQ ID NO: 1812 - RNA, 21 nt, Artificial Sequence
  Synthetic oligonucleotide
aagccugagaagagccuggcc

SEQ ID NO: 1813 - RNA, 21 nt, Artificial Sequence
  Synthetic oligonucleotide
agccugagaagagccuggcca

SEQ ID NO: 1814 - RNA, 21 nt, Artificial Sequence
  Synthetic oligonucleotide
gccugagaagagccuggccaa

SEQ ID NO: 1815 - RNA, 21 nt, Artificial Sequence
  Synthetic oligonucleotide
ccugagaagagccuggccaag

SEQ ID NO: 1816 - RNA, 21 nt, Artificial Sequence
  Synthetic oligonucleotide
cugagaagagccuggccaagg

SEQ ID NO: 1817 - RNA, 21 nt, Artificial Sequence
  Synthetic oligonucleotide
ugagaagagccuggccaaggu

SEQ ID NO: 1818 - RNA, 21 nt, Artificial Sequence
  Synthetic oligonucleotide
uggugguccacaugccccgcu

SEQ ID NO: 1819 - RNA, 21 nt, Artificial Sequence
  Synthetic oligonucleotide
ggugguccacaugccccgcuu

SEQ ID NO: 1820 - RNA, 21 nt, Artificial Sequence
  Synthetic oligonucleotide
gugguccacaugccccgcuuc

SEQ ID NO: 1821 - RNA, 21 nt, Artificial Sequence
  Synthetic oligonucleotide
ugguccacaugccccgcuucc

SEQ ID NO: 1822 - RNA, 21 nt, Artificial Sequence
  Synthetic oligonucleotide
gguccacaugccccgcuuccg

SEQ ID NO: 1823 - RNA, 21 nt, Artificial Sequence
  Synthetic oligonucleotide
guccacaugccccgcuuccgc

SEQ ID NO: 1824 - RNA, 21 nt, Artificial Sequence
  Synthetic oligonucleotide
uccacaugccccgcuuccgca

SEQ ID NO: 1825 - RNA, 21 nt, Artificial Sequence
  Synthetic oligonucleotide
ucaguuugaaggagcagcugc

SEQ ID NO: 1826 - RNA, 21 nt, Artificial Sequence
  Synthetic oligonucleotide
caguuugaaggagcagcugca

SEQ ID NO: 1827 - RNA, 21 nt, Artificial Sequence
  Synthetic oligonucleotide
uuugaaggagcagcugcaaga

SEQ ID NO: 1828 - RNA, 21 nt, Artificial Sequence
  Synthetic oligonucleotide
uugaaggagcagcugcaagac

SEQ ID NO: 1829 - RNA, 21 nt, Artificial Sequence
  Synthetic oligonucleotide
ugaaggagcagcugcaagaca

SEQ ID NO: 1830 - RNA, 21 nt, Artificial Sequence
  Synthetic oligonucleotide
gaaggagcagcugcaagacau

SEQ ID NO: 1831 - RNA, 21 nt, Artificial Sequence
  Synthetic oligonucleotide
aaggagcagcugcaagacaug

SEQ ID NO: 1832 - RNA, 21 nt, Artificial Sequence
  Synthetic oligonucleotide
aggagcagcugcaagacaugg

SEQ ID NO: 1833 - RNA, 21 nt, Artificial Sequence
  Synthetic oligonucleotide
ggagcagcugcaagacauggg

SEQ ID NO: 1834 - RNA, 21 nt, Artificial Sequence
  Synthetic oligonucleotide
gagcagcugcaagacaugggc

SEQ ID NO: 1835 - RNA, 21 nt, Artificial Sequence
  Synthetic oligonucleotide
agcagcugcaagacaugggcc

SEQ ID NO: 1836 - RNA, 21 nt, Artificial Sequence
  Synthetic oligonucleotide
gcagcugcaagacaugggccu

SEQ ID NO: 1837 - RNA, 21 nt, Artificial Sequence
  Synthetic oligonucleotide
ccuugucgaucuguucagccc

SEQ ID NO: 1838 - RNA, 21 nt, Artificial Sequence
  Synthetic oligonucleotide
uugucgaucuguucagcccug

SEQ ID NO: 1839 - RNA, 21 nt, Artificial Sequence
  Synthetic oligonucleotide
ugucgaucuguucagcccuga

SEQ ID NO: 1840 - RNA, 21 nt, Artificial Sequence
  Synthetic oligonucleotide
ucgaucuguucagcccugaaa

SEQ ID NO: 1841 - RNA, 21 nt, Artificial Sequence
  Synthetic oligonucleotide
aucuguucagcccugaaaagu

SEQ ID NO: 1842 - RNA, 21 nt, Artificial Sequence
  Synthetic oligonucleotide
cuguucagcccugaaaagucc

SEQ ID NO: 1843 - RNA, 21 nt, Artificial Sequence
  Synthetic oligonucleotide
gaaaaguccaaacucccaggu

SEQ ID NO: 1844 - RNA, 21 nt, Artificial Sequence
  Synthetic oligonucleotide
aaaaguccaaacucccaggua

SEQ ID NO: 1845 - RNA, 21 nt, Artificial Sequence
  Synthetic oligonucleotide
aaguccaaacucccagguauu

SEQ ID NO: 1846 - RNA, 21 nt, Artificial Sequence
  Synthetic oligonucleotide
guccaaacucccagguauugu

SEQ ID NO: 1847 - RNA, 21 nt, Artificial Sequence
  Synthetic oligonucleotide
uccaaacucccagguauuguu

SEQ ID NO: 1848 - RNA, 21 nt, Artificial Sequence
  Synthetic oligonucleotide
ccaaacucccagguauuguug

SEQ ID NO: 1849 - RNA, 21 nt, Artificial Sequence
  Synthetic oligonucleotide
caaacucccagguauuguugc

SEQ ID NO: 1850 - RNA, 21 nt, Artificial Sequence
  Synthetic oligonucleotide
uccauaaggcauuucuugagg

SEQ ID NO: 1851 - RNA, 21 nt, Artificial Sequence
  Synthetic oligonucleotide
ccauaaggcauuucuugaggu

SEQ ID NO: 1852 - RNA, 21 nt, Artificial Sequence
  Synthetic oligonucleotide
cauaaggcauuucuugaggua

SEQ ID NO: 1853 - RNA, 21 nt, Artificial Sequence
  Synthetic oligonucleotide
auaaggcauuucuugagguaa

SEQ ID NO: 1854 - RNA, 21 nt, Artificial Sequence
  Synthetic oligonucleotide
uaaggcauuucuugagguaaa

SEQ ID NO: 1855 - RNA, 21 nt, Artificial Sequence
  Synthetic oligonucleotide
aaggcauuucuugagguaaau

SEQ ID NO: 1856 - RNA, 21 nt, Artificial Sequence
  Synthetic oligonucleotide
aggcauuucuugagguaaaug

SEQ ID NO: 1857 - RNA, 21 nt, Artificial Sequence
  Synthetic oligonucleotide
ggcauuucuugagguaaauga

SEQ ID NO: 1858 - RNA, 21 nt, Artificial Sequence
  Synthetic oligonucleotide
cuugagguaaaugaagaaggc

SEQ ID NO: 1859 - RNA, 21 nt, Artificial Sequence
  Synthetic oligonucleotide
uugagguaaaugaagaaggca

SEQ ID NO: 1860 - RNA, 21 nt, Artificial Sequence
  Synthetic oligonucleotide
ugagguaaaugaagaaggcag

SEQ ID NO: 1861 - RNA, 21 nt, Artificial Sequence
  Synthetic oligonucleotide
gagguaaaugaagaaggcagu

SEQ ID NO: 1862 - RNA, 21 nt, Artificial Sequence
  Synthetic oligonucleotide
agguaaaugaagaaggcagug

SEQ ID NO: 1863 - RNA, 21 nt, Artificial Sequence
  Synthetic oligonucleotide
gguaaaugaagaaggcaguga

SEQ ID NO: 1864 - RNA, 21 nt, Artificial Sequence
  Synthetic oligonucleotide
guaaaugaagaaggcagugaa

SEQ ID NO: 1865 - RNA, 21 nt, Artificial Sequence
  Synthetic oligonucleotide
ugaagaaggcagugaagcagc

SEQ ID NO: 1866 - RNA, 21 nt, Artificial Sequence
  Synthetic oligonucleotide
agaaggcagugaagcagcugc

SEQ ID NO: 1867 - RNA, 21 nt, Artificial Sequence
  Synthetic oligonucleotide
gaaggcagugaagcagcugca

SEQ ID NO: 1868 - RNA, 21 nt, Artificial Sequence
  Synthetic oligonucleotide
ugaagcagcugcaaguaccgc

SEQ ID NO: 1869 - RNA, 21 nt, Artificial Sequence
  Synthetic oligonucleotide
ccaacaggccuuuccugguuu

SEQ ID NO: 1870 - RNA, 21 nt, Artificial Sequence
  Synthetic oligonucleotide
caacaggccuuuccugguuuu

SEQ ID NO: 1871 - RNA, 21 nt, Artificial Sequence
  Synthetic oligonucleotide
aacaggccuuuccugguuuuu

SEQ ID NO: 1872 - RNA, 21 nt, Artificial Sequence
  Synthetic oligonucleotide
acaggccuuuccugguuuuua

SEQ ID NO: 1873 - RNA, 21 nt, Artificial Sequence
  Synthetic oligonucleotide
caggccuuuccugguuuuuau

SEQ ID NO: 1874 - RNA, 21 nt, Artificial Sequence
  Synthetic oligonucleotide
aggccuuuccugguuuuuaua

SEQ ID NO: 1875 - RNA, 21 nt, Artificial Sequence
  Synthetic oligonucleotide
gccuuuccugguuuuuauaag

SEQ ID NO: 1876 - RNA, 21 nt, Artificial Sequence
  Synthetic oligonucleotide
ccuuuccugguuuuuauaaga

SEQ ID NO: 1877 - RNA, 21 nt, Artificial Sequence
  Synthetic oligonucleotide
cuuuccugguuuuuauaagag

SEQ ID NO: 1878 - RNA, 21 nt, Artificial Sequence
  Synthetic oligonucleotide
uuuccugguuuuuauaagaga

SEQ ID NO: 1879 - RNA, 21 nt, Artificial Sequence
  Synthetic oligonucleotide
uuccugguuuuuauaagagaa

SEQ ID NO: 1880 - RNA, 21 nt, Artificial Sequence
  Synthetic oligonucleotide
uccugguuuuuauaagagaag

SEQ ID NO: 1881 - RNA, 21 nt, Artificial Sequence
  Synthetic oligonucleotide
ccugguuuuuauaagagaagu

SEQ ID NO: 1882 - RNA, 21 nt, Artificial Sequence
  Synthetic oligonucleotide
cugguuuuuauaagagaaguu

SEQ ID NO: 1883 - RNA, 21 nt, Artificial Sequence
  Synthetic oligonucleotide
ugguuuuuauaagagaaguuc

SEQ ID NO: 1884 - RNA, 21 nt, Artificial Sequence
  Synthetic oligonucleotide
gguuuuuauaagagaaguucc

SEQ ID NO: 1885 - RNA, 21 nt, Artificial Sequence
  Synthetic oligonucleotide
guuuuuauaagagaaguuccu

SEQ ID NO: 1886 - RNA, 21 nt, Artificial Sequence
  Synthetic oligonucleotide
uuuuuauaagagaaguuccuc

SEQ ID NO: 1887 - RNA, 21 nt, Artificial Sequence
  Synthetic oligonucleotide
uuuuauaagagaaguuccucu

SEQ ID NO: 1888 - RNA, 21 nt, Artificial Sequence
  Synthetic oligonucleotide
uuuauaagagaaguuccucug

SEQ ID NO: 1889 - RNA, 21 nt, Artificial Sequence
  Synthetic oligonucleotide
uuauaagagaaguuccucuga

SEQ ID NO: 1890 - RNA, 21 nt, Artificial Sequence
  Synthetic oligonucleotide
uauaagagaaguuccucugaa

SEQ ID NO: 1891 - RNA, 21 nt, Artificial Sequence
  Synthetic oligonucleotide
auaagagaaguuccucugaac

SEQ ID NO: 1892 - RNA, 21 nt, Artificial Sequence
  Synthetic oligonucleotide
uaagagaaguuccucugaaca

SEQ ID NO: 1893 - RNA, 21 nt, Artificial Sequence
  Synthetic oligonucleotide
aagagaaguuccucugaacac

SEQ ID NO: 1894 - RNA, 21 nt, Artificial Sequence
  Synthetic oligonucleotide
agagaaguuccucugaacacu

SEQ ID NO: 1895 - RNA, 21 nt, Artificial Sequence
  Synthetic oligonucleotide
gagaaguuccucugaacacua

SEQ ID NO: 1896 - RNA, 21 nt, Artificial Sequence
  Synthetic oligonucleotide
agaaguuccucugaacacuau

SEQ ID NO: 1897 - RNA, 21 nt, Artificial Sequence
  Synthetic oligonucleotide
gaaguuccucugaacacuauu

SEQ ID NO: 1898 - RNA, 21 nt, Artificial Sequence
  Synthetic oligonucleotide
aaguuccucugaacacuauua

SEQ ID NO: 1899 - RNA, 21 nt, Artificial Sequence
  Synthetic oligonucleotide
aguuccucugaacacuauuau

SEQ ID NO: 1900 - RNA, 21 nt, Artificial Sequence
  Synthetic oligonucleotide
guuccucugaacacuauuauc

SEQ ID NO: 1901 - RNA, 21 nt, Artificial Sequence
  Synthetic oligonucleotide
uuccucugaacacuauuaucu

SEQ ID NO: 1902 - RNA, 21 nt, Artificial Sequence
  Synthetic oligonucleotide
uccucugaacacuauuaucuu

SEQ ID NO: 1903 - RNA, 21 nt, Artificial Sequence
  Synthetic oligonucleotide
cucugaacacuauuaucuuca

SEQ ID NO: 1904 - RNA, 21 nt, Artificial Sequence
  Synthetic oligonucleotide
aacacuauuaucuucaugggc

SEQ ID NO: 1905 - RNA, 21 nt, Artificial Sequence
  Synthetic oligonucleotide
acagaaguaaaaauaaauaca

SEQ ID NO: 1906 - RNA, 21 nt, Artificial Sequence
  Synthetic oligonucleotide
cagaaguaaaaauaaauacaa

SEQ ID NO: 1907 - RNA, 21 nt, Artificial Sequence
  Synthetic oligonucleotide
guggugagauauaagacauaa

SEQ ID NO: 1908 - RNA, 21 nt, Artificial Sequence
  Synthetic oligonucleotide
caagcagcugauggagguuuu

SEQ ID NO: 1909 - RNA, 21 nt, Artificial Sequence
  Synthetic oligonucleotide
ugauggagguuuuuaaauuug

SEQ ID NO: 1910 - RNA, 21 nt, Artificial Sequence
  Synthetic oligonucleotide
agggaaguugcacugaacacu

SEQ ID NO: 1911 - RNA, 21 nt, Artificial Sequence
  Synthetic oligonucleotide
gaaguugcacugaacacuauu

SEQ ID NO: 1912 - RNA, 21 nt, Artificial Sequence
  Synthetic oligonucleotide
aguugcacugaacacuauuau

SEQ ID NO: 1913 - RNA, 21 nt, Artificial Sequence
  Synthetic oligonucleotide
uacuuugguguuugugaauag

SEQ ID NO: 1914 - RNA, 21 nt, Artificial Sequence
  Synthetic oligonucleotide
uugguguuugugaauagaagu

SEQ ID NO: 1915 - RNA, 21 nt, Artificial Sequence
  Synthetic oligonucleotide
ugguguuugugaauagaagua

SEQ ID NO: 1916 - RNA, 21 nt, Artificial Sequence
  Synthetic oligonucleotide
gguguuugugaauagaaguaa

SEQ ID NO: 1917 - RNA, 21 nt, Artificial Sequence
  Synthetic oligonucleotide
guguuugugaauagaaguaaa

SEQ ID NO: 1918 - RNA, 21 nt, Artificial Sequence
  Synthetic oligonucleotide
uugugaauagaaguaaaaaua

SEQ ID NO: 1919 - RNA, 21 nt, Artificial Sequence
  Synthetic oligonucleotide
acaagagguaaauauauuacu

SEQ ID NO: 1920 - RNA, 21 nt, Artificial Sequence
  Synthetic oligonucleotide
agagaaaugcauuuuuauaca

SEQ ID NO: 1921 - RNA, 27 nt, Artificial Sequence
  Synthetic oligonucleotide
ggccauguauuccaaugugauaggaac

SEQ ID NO: 1922 - RNA, 27 nt, Artificial Sequence
  Synthetic oligonucleotide
gccauguauuccaaugugauaggaacu

SEQ ID NO: 1923 - RNA, 27 nt, Artificial Sequence
  Synthetic oligonucleotide
ccauguauuccaaugugauaggaacug

SEQ ID NO: 1924 - RNA, 27 nt, Artificial Sequence
  Synthetic oligonucleotide
cauguauuccaaugugauaggaacugu

SEQ ID NO: 1925 - RNA, 27 nt, Artificial Sequence
  Synthetic oligonucleotide
auguauuccaaugugauaggaacugua

SEQ ID NO: 1926 - RNA, 27 nt, Artificial Sequence
  Synthetic oligonucleotide
uguauuccaaugugauaggaacuguaa

SEQ ID NO: 1927 - RNA, 27 nt, Artificial Sequence
  Synthetic oligonucleotide
guauuccaaugugauaggaacuguaac

SEQ ID NO: 1928 - RNA, 27 nt, Artificial Sequence
  Synthetic oligonucleotide
accucuggaaaaaggaagguuuaucuu

SEQ ID NO: 1929 - RNA, 27 nt, Artificial Sequence
  Synthetic oligonucleotide
ccucuggaaaaaggaagguuuaucuuu

SEQ ID NO: 1930 - RNA, 27 nt, Artificial Sequence
  Synthetic oligonucleotide
cucuggaaaaaggaagguuuaucuuuu

SEQ ID NO: 1931 - RNA, 27 nt, Artificial Sequence
  Synthetic oligonucleotide
cuggaaaaaggaagguuuaucuuuugu

SEQ ID NO: 1932 - RNA, 27 nt, Artificial Sequence
  Synthetic oligonucleotide
uggaaaaaggaagguuuaucuuuuguc

SEQ ID NO: 1933 - RNA, 27 nt, Artificial Sequence
  Synthetic oligonucleotide
ggaaaaaggaagguuuaucuuuugucc

SEQ ID NO: 1934 - RNA, 27 nt, Artificial Sequence
  Synthetic oligonucleotide
auucccaugaaucccaugugcauuuac

SEQ ID NO: 1935 - RNA, 27 nt, Artificial Sequence
  Synthetic oligonucleotide
uucccaugaaucccaugugcauuuacc

SEQ ID NO: 1936 - RNA, 27 nt, Artificial Sequence
  Synthetic oligonucleotide
ccaugaaucccaugugcauuuaccgcu

SEQ ID NO: 1937 - RNA, 27 nt, Artificial Sequence
  Synthetic oligonucleotide
caugugcauuuaccgcuccccggagaa

SEQ ID NO: 1938 - RNA, 27 nt, Artificial Sequence
  Synthetic oligonucleotide
gugucugggaacuguccaaggccaauu

SEQ ID NO: 1939 - RNA, 27 nt, Artificial Sequence
  Synthetic oligonucleotide
ugucugggaacuguccaaggccaauuc

SEQ ID NO: 1940 - RNA, 27 nt, Artificial Sequence
  Synthetic oligonucleotide
gucugggaacuguccaaggccaauucc

SEQ ID NO: 1941 - RNA, 27 nt, Artificial Sequence
  Synthetic oligonucleotide
ucugggaacuguccaaggccaauuccc

SEQ ID NO: 1942 - RNA, 27 nt, Artificial Sequence
  Synthetic oligonucleotide
cugggaacuguccaaggccaauucccg

SEQ ID NO: 1943 - RNA, 27 nt, Artificial Sequence
  Synthetic oligonucleotide
ugggaacuguccaaggccaauucccgc

SEQ ID NO: 1944 - RNA, 27 nt, Artificial Sequence
  Synthetic oligonucleotide
gggaacuguccaaggccaauucccgcu

SEQ ID NO: 1945 - RNA, 27 nt, Artificial Sequence
  Synthetic oligonucleotide
ggaacuguccaaggccaauucccgcuu

SEQ ID NO: 1946 - RNA, 27 nt, Artificial Sequence
  Synthetic oligonucleotide
caauucccgcuuugcuaccacuuucua

SEQ ID NO: 1947 - RNA, 27 nt, Artificial Sequence
  Synthetic oligonucleotide
uucccgcuuugcuaccacuuucuauca

SEQ ID NO: 1948 - RNA, 27 nt, Artificial Sequence
  Synthetic oligonucleotide
ucccgcuuugcuaccacuuucuaucag

SEQ ID NO: 1949 - RNA, 27 nt, Artificial Sequence
  Synthetic oligonucleotide
cccgcuuugcuaccacuuucuaucagc

SEQ ID NO: 1950 - RNA, 27 nt, Artificial Sequence
  Synthetic oligonucleotide
ccgcuuugcuaccacuuucuaucagca

SEQ ID NO: 1951 - RNA, 27 nt, Artificial Sequence
  Synthetic oligonucleotide
cgcuuugcuaccacuuucuaucagcac

SEQ ID NO: 1952 - RNA, 27 nt, Artificial Sequence
  Synthetic oligonucleotide
gcuuugcuaccacuuucuaucagcacc

SEQ ID NO: 1953 - RNA, 27 nt, Artificial Sequence
  Synthetic oligonucleotide
cuuugcuaccacuuucuaucagcaccu

SEQ ID NO: 1954 - RNA, 27 nt, Artificial Sequence
  Synthetic oligonucleotide
uuugcuaccacuuucuaucagcaccug

SEQ ID NO: 1955 - RNA, 27 nt, Artificial Sequence
  Synthetic oligonucleotide
uugcuaccacuuucuaucagcaccugg

SEQ ID NO: 1956 - RNA, 27 nt, Artificial Sequence
  Synthetic oligonucleotide
gcaccuggcagauuccaagaaugacaa

SEQ ID NO: 1957 - RNA, 27 nt, Artificial Sequence
  Synthetic oligonucleotide
augauaacauuuuccugucaccccuga

SEQ ID NO: 1958 - RNA, 27 nt, Artificial Sequence
  Synthetic oligonucleotide
auaacauuuuccugucaccccugagua

SEQ ID NO: 1959 - RNA, 27 nt, Artificial Sequence
  Synthetic oligonucleotide
aacauuuuccugucaccccugaguauc

SEQ ID NO: 1960 - RNA, 27 nt, Artificial Sequence
  Synthetic oligonucleotide
cggcuuuugcuaugaccaagcugggug

SEQ ID NO: 1961 - RNA, 27 nt, Artificial Sequence
  Synthetic oligonucleotide
ggcuuuugcuaugaccaagcugggugc

SEQ ID NO: 1962 - RNA, 27 nt, Artificial Sequence
  Synthetic oligonucleotide
gcuuuugcuaugaccaagcugggugcc

SEQ ID NO: 1963 - RNA, 27 nt, Artificial Sequence
  Synthetic oligonucleotide
cuuuugcuaugaccaagcugggugccu

SEQ ID NO: 1964 - RNA, 27 nt, Artificial Sequence
  Synthetic oligonucleotide
uuuugcuaugaccaagcugggugccug

SEQ ID NO: 1965 - RNA, 27 nt, Artificial Sequence
  Synthetic oligonucleotide
uuugcuaugaccaagcugggugccugu

SEQ ID NO: 1966 - RNA, 27 nt, Artificial Sequence
  Synthetic oligonucleotide
uugcuaugaccaagcugggugccugua

SEQ ID NO: 1967 - RNA, 27 nt, Artificial Sequence
  Synthetic oligonucleotide
ugcuaugaccaagcugggugccuguaa

SEQ ID NO: 1968 - RNA, 27 nt, Artificial Sequence
  Synthetic oligonucleotide
gcuaugaccaagcugggugccuguaau

SEQ ID NO: 1969 - RNA, 27 nt, Artificial Sequence
  Synthetic oligonucleotide
cuaugaccaagcugggugccuguaaug

SEQ ID NO: 1970 - RNA, 27 nt, Artificial Sequence
  Synthetic oligonucleotide
uaugaccaagcugggugccuguaauga

SEQ ID NO: 1971 - RNA, 27 nt, Artificial Sequence
  Synthetic oligonucleotide
augaccaagcugggugccuguaaugac

SEQ ID NO: 1972 - RNA, 27 nt, Artificial Sequence
  Synthetic oligonucleotide
ugaccaagcugggugccuguaaugaca

SEQ ID NO: 1973 - RNA, 27 nt, Artificial Sequence
  Synthetic oligonucleotide
gaccaagcugggugccuguaaugacac

SEQ ID NO: 1974 - RNA, 27 nt, Artificial Sequence
  Synthetic oligonucleotide
ccagcaacugauggagguauuuaaguu

SEQ ID NO: 1975 - RNA, 27 nt, Artificial Sequence
  Synthetic oligonucleotide
cagcaacugauggagguauuuaaguuu

SEQ ID NO: 1976 - RNA, 27 nt, Artificial Sequence
  Synthetic oligonucleotide
agcaacugauggagguauuuaaguuug

SEQ ID NO: 1977 - RNA, 27 nt, Artificial Sequence
  Synthetic oligonucleotide
gcaacugauggagguauuuaaguuuga

SEQ ID NO: 1978 - RNA, 27 nt, Artificial Sequence
  Synthetic oligonucleotide
caacugauggagguauuuaaguuugac

SEQ ID NO: 1979 - RNA, 27 nt, Artificial Sequence
  Synthetic oligonucleotide
aacugauggagguauuuaaguuugaca

SEQ ID NO: 1980 - RNA, 27 nt, Artificial Sequence
  Synthetic oligonucleotide
acugauggagguauuuaaguuugacac

SEQ ID NO: 1981 - RNA, 27 nt, Artificial Sequence
  Synthetic oligonucleotide
cugauggagguauuuaaguuugacacc

SEQ ID NO: 1982 - RNA, 27 nt, Artificial Sequence
  Synthetic oligonucleotide
ugauggagguauuuaaguuugacacca

SEQ ID NO: 1983 - RNA, 27 nt, Artificial Sequence
  Synthetic oligonucleotide
gauggagguauuuaaguuugacaccau

SEQ ID NO: 1984 - RNA, 27 nt, Artificial Sequence
  Synthetic oligonucleotide
auggagguauuuaaguuugacaccaua

SEQ ID NO: 1985 - RNA, 27 nt, Artificial Sequence
  Synthetic oligonucleotide
uggagguauuuaaguuugacaccauau

SEQ ID NO: 1986 - RNA, 27 nt, Artificial Sequence
  Synthetic oligonucleotide
ggagguauuuaaguuugacaccauauc

SEQ ID NO: 1987 - RNA, 27 nt, Artificial Sequence
  Synthetic oligonucleotide
gagguauuuaaguuugacaccauaucu

SEQ ID NO: 1988 - RNA, 27 nt, Artificial Sequence
  Synthetic oligonucleotide
agguauuuaaguuugacaccauaucug

SEQ ID NO: 1989 - RNA, 27 nt, Artificial Sequence
  Synthetic oligonucleotide
gguauuuaaguuugacaccauaucuga

SEQ ID NO: 1990 - RNA, 27 nt, Artificial Sequence
  Synthetic oligonucleotide
guauuuaaguuugacaccauaucugag

SEQ ID NO: 1991 - RNA, 27 nt, Artificial Sequence
  Synthetic oligonucleotide
uauuuaaguuugacaccauaucugaga

SEQ ID NO: 1992 - RNA, 27 nt, Artificial Sequence
  Synthetic oligonucleotide
auuuaaguuugacaccauaucugagaa

SEQ ID NO: 1993 - RNA, 27 nt, Artificial Sequence
  Synthetic oligonucleotide
uuuaaguuugacaccauaucugagaaa

SEQ ID NO: 1994 - RNA, 27 nt, Artificial Sequence
  Synthetic oligonucleotide
uuaaguuugacaccauaucugagaaaa

SEQ ID NO: 1995 - RNA, 27 nt, Artificial Sequence
  Synthetic oligonucleotide
uaaguuugacaccauaucugagaaaac

SEQ ID NO: 1996 - RNA, 27 nt, Artificial Sequence
  Synthetic oligonucleotide
aaguuugacaccauaucugagaaaaca

SEQ ID NO: 1997 - RNA, 27 nt, Artificial Sequence
  Synthetic oligonucleotide
aguuugacaccauaucugagaaaacau

SEQ ID NO: 1998 - RNA, 27 nt, Artificial Sequence
  Synthetic oligonucleotide
guuugacaccauaucugagaaaacauc

SEQ ID NO: 1999 - RNA, 27 nt, Artificial Sequence
  Synthetic oligonucleotide
uuugacaccauaucugagaaaacaucu

SEQ ID NO: 2000 - RNA, 27 nt, Artificial Sequence
  Synthetic oligonucleotide
uugacaccauaucugagaaaacaucug

SEQ ID NO: 2001 - RNA, 27 nt, Artificial Sequence
  Synthetic oligonucleotide
ugacaccauaucugagaaaacaucuga

SEQ ID NO: 2002 - RNA, 27 nt, Artificial Sequence
  Synthetic oligonucleotide
gacaccauaucugagaaaacaucugau

SEQ ID NO: 2003 - RNA, 27 nt, Artificial Sequence
  Synthetic oligonucleotide
acaccauaucugagaaaacaucugauc

SEQ ID NO: 2004 - RNA, 27 nt, Artificial Sequence
  Synthetic oligonucleotide
caccauaucugagaaaacaucugauca

SEQ ID NO: 2005 - RNA, 27 nt, Artificial Sequence
  Synthetic oligonucleotide
accauaucugagaaaacaucugaucag

SEQ ID NO: 2006 - RNA, 27 nt, Artificial Sequence
  Synthetic oligonucleotide
ccauaucugagaaaacaucugaucaga

SEQ ID NO: 2007 - RNA, 27 nt, Artificial Sequence
  Synthetic oligonucleotide
cauaucugagaaaacaucugaucagau

SEQ ID NO: 2008 - RNA, 27 nt, Artificial Sequence
  Synthetic oligonucleotide
aucugagaaaacaucugaucagaucca

SEQ ID NO: 2009 - RNA, 27 nt, Artificial Sequence
  Synthetic oligonucleotide
ucugagaaaacaucugaucagauccac

SEQ ID NO: 2010 - RNA, 27 nt, Artificial Sequence
  Synthetic oligonucleotide
cugagaaaacaucugaucagauccacu

SEQ ID NO: 2011 - RNA, 27 nt, Artificial Sequence
  Synthetic oligonucleotide
ugagaaaacaucugaucagauccacuu

SEQ ID NO: 2012 - RNA, 27 nt, Artificial Sequence
  Synthetic oligonucleotide
ugaucagauccacuucuucuuugccaa

SEQ ID NO: 2013 - RNA, 27 nt, Artificial Sequence
  Synthetic oligonucleotide
aucagauccacuucuucuuugccaaac

SEQ ID NO: 2014 - RNA, 27 nt, Artificial Sequence
  Synthetic oligonucleotide
ucagauccacuucuucuuugccaaacu

SEQ ID NO: 2015 - RNA, 27 nt, Artificial Sequence
  Synthetic oligonucleotide
cagauccacuucuucuuugccaaacug

SEQ ID NO: 2016 - RNA, 27 nt, Artificial Sequence
  Synthetic oligonucleotide
agauccacuucuucuuugccaaacuga

SEQ ID NO: 2017 - RNA, 27 nt, Artificial Sequence
  Synthetic oligonucleotide
gauccacuucuucuuugccaaacugaa

SEQ ID NO: 2018 - RNA, 27 nt, Artificial Sequence
  Synthetic oligonucleotide
auccacuucuucuuugccaaacugaac

SEQ ID NO: 2019 - RNA, 27 nt, Artificial Sequence
  Synthetic oligonucleotide
uccacuucuucuuugccaaacugaacu

SEQ ID NO: 2020 - RNA, 27 nt, Artificial Sequence
  Synthetic oligonucleotide
ccacuucuucuuugccaaacugaacug

SEQ ID NO: 2021 - RNA, 27 nt, Artificial Sequence
  Synthetic oligonucleotide
cacuucuucuuugccaaacugaacugc

SEQ ID NO: 2022 - RNA, 27 nt, Artificial Sequence
  Synthetic oligonucleotide
acuucuucuuugccaaacugaacugcc

SEQ ID NO: 2023 - RNA, 27 nt, Artificial Sequence
  Synthetic oligonucleotide
cuucuucuuugccaaacugaacugccg

SEQ ID NO: 2024 - RNA, 27 nt, Artificial Sequence
  Synthetic oligonucleotide
uucuucuuugccaaacugaacugccga

SEQ ID NO: 2025 - RNA, 27 nt, Artificial Sequence
  Synthetic oligonucleotide
ucuucuuugccaaacugaacugccgac

SEQ ID NO: 2026 - RNA, 27 nt, Artificial Sequence
  Synthetic oligonucleotide
cuucuuugccaaacugaacugccgacu

SEQ ID NO: 2027 - RNA, 27 nt, Artificial Sequence
  Synthetic oligonucleotide
uucuuugccaaacugaacugccgacuc

SEQ ID NO: 2028 - RNA, 27 nt, Artificial Sequence
  Synthetic oligonucleotide
ucuuugccaaacugaacugccgacucu

SEQ ID NO: 2029 - RNA, 27 nt, Artificial Sequence
  Synthetic oligonucleotide
cuuugccaaacugaacugccgacucua

SEQ ID NO: 2030 - RNA, 27 nt, Artificial Sequence
  Synthetic oligonucleotide
uuugccaaacugaacugccgacucuau

SEQ ID NO: 2031 - RNA, 27 nt, Artificial Sequence
  Synthetic oligonucleotide
uugccaaacugaacugccgacucuauc

SEQ ID NO: 2032 - RNA, 27 nt, Artificial Sequence
  Synthetic oligonucleotide
ugccaaacugaacugccgacucuaucg

SEQ ID NO: 2033 - RNA, 27 nt, Artificial Sequence
  Synthetic oligonucleotide
gccaaacugaacugccgacucuaucga

SEQ ID NO: 2034 - RNA, 27 nt, Artificial Sequence
  Synthetic oligonucleotide
ccaaacugaacugccgacucuaucgaa

SEQ ID NO: 2035 - RNA, 27 nt, Artificial Sequence
  Synthetic oligonucleotide
caaacugaacugccgacucuaucgaaa

SEQ ID NO: 2036 - RNA, 27 nt, Artificial Sequence
  Synthetic oligonucleotide
aaacugaacugccgacucuaucgaaaa

SEQ ID NO: 2037 - RNA, 27 nt, Artificial Sequence
  Synthetic oligonucleotide
aacugaacugccgacucuaucgaaaag

SEQ ID NO: 2038 - RNA, 27 nt, Artificial Sequence
  Synthetic oligonucleotide
acugaacugccgacucuaucgaaaagc

SEQ ID NO: 2039 - RNA, 27 nt, Artificial Sequence
  Synthetic oligonucleotide
cugaacugccgacucuaucgaaaagcc

SEQ ID NO: 2040 - RNA, 27 nt, Artificial Sequence
  Synthetic oligonucleotide
ugaacugccgacucuaucgaaaagcca

SEQ ID NO: 2041 - RNA, 27 nt, Artificial Sequence
  Synthetic oligonucleotide
gaacugccgacucuaucgaaaagccaa

SEQ ID NO: 2042 - RNA, 27 nt, Artificial Sequence
  Synthetic oligonucleotide
aacugccgacucuaucgaaaagccaac

SEQ ID NO: 2043 - RNA, 27 nt, Artificial Sequence
  Synthetic oligonucleotide
acugccgacucuaucgaaaagccaaca

SEQ ID NO: 2044 - RNA, 27 nt, Artificial Sequence
  Synthetic oligonucleotide
cugccgacucuaucgaaaagccaacaa

SEQ ID NO: 2045 - RNA, 27 nt, Artificial Sequence
  Synthetic oligonucleotide
ugccgacucuaucgaaaagccaacaaa

SEQ ID NO: 2046 - RNA, 27 nt, Artificial Sequence
  Synthetic oligonucleotide
gccgacucuaucgaaaagccaacaaau

SEQ ID NO: 2047 - RNA, 27 nt, Artificial Sequence
  Synthetic oligonucleotide
ccgacucuaucgaaaagccaacaaauc

SEQ ID NO: 2048 - RNA, 27 nt, Artificial Sequence
  Synthetic oligonucleotide
cgacucuaucgaaaagccaacaaaucc

SEQ ID NO: 2049 - RNA, 27 nt, Artificial Sequence
  Synthetic oligonucleotide
gacucuaucgaaaagccaacaaauccu

SEQ ID NO: 2050 - RNA, 27 nt, Artificial Sequence
  Synthetic oligonucleotide
acucuaucgaaaagccaacaaauccuc

SEQ ID NO: 2051 - RNA, 27 nt, Artificial Sequence
  Synthetic oligonucleotide
cgaaaagccaacaaauccuccaaguua

SEQ ID NO: 2052 - RNA, 27 nt, Artificial Sequence
  Synthetic oligonucleotide
gaaaagccaacaaauccuccaaguuag

SEQ ID NO: 2053 - RNA, 27 nt, Artificial Sequence
  Synthetic oligonucleotide
aagccaacaaauccuccaaguuaguau

SEQ ID NO: 2054 - RNA, 27 nt, Artificial Sequence
  Synthetic oligonucleotide
agccaacaaauccuccaaguuaguauc

SEQ ID NO: 2055 - RNA, 27 nt, Artificial Sequence
  Synthetic oligonucleotide
gccaacaaauccuccaaguuaguauca

SEQ ID NO: 2056 - RNA, 27 nt, Artificial Sequence
  Synthetic oligonucleotide
ccaacaaauccuccaaguuaguaucag

SEQ ID NO: 2057 - RNA, 27 nt, Artificial Sequence
  Synthetic oligonucleotide
caacaaauccuccaaguuaguaucagc

SEQ ID NO: 2058 - RNA, 27 nt, Artificial Sequence
  Synthetic oligonucleotide
aacaaauccuccaaguuaguaucagcc

SEQ ID NO: 2059 - RNA, 27 nt, Artificial Sequence
  Synthetic oligonucleotide
caaguuaguaucagccaaucgccuuuu

SEQ ID NO: 2060 - RNA, 27 nt, Artificial Sequence
  Synthetic oligonucleotide
uuaguaucagccaaucgccuuuuugga

SEQ ID NO: 2061 - RNA, 27 nt, Artificial Sequence
  Synthetic oligonucleotide
aucagccaaucgccuuuuuggagacaa

SEQ ID NO: 2062 - RNA, 27 nt, Artificial Sequence
  Synthetic oligonucleotide
ucagccaaucgccuuuuuggagacaaa

SEQ ID NO: 2063 - RNA, 27 nt, Artificial Sequence
  Synthetic oligonucleotide
cagccaaucgccuuuuuggagacaaau

SEQ ID NO: 2064 - RNA, 27 nt, Artificial Sequence
  Synthetic oligonucleotide
caaucgccuuuuuggagacaaaucccu

SEQ ID NO: 2065 - RNA, 27 nt, Artificial Sequence
  Synthetic oligonucleotide
aucgccuuuuuggagacaaaucccuua

SEQ ID NO: 2066 - RNA, 27 nt, Artificial Sequence
  Synthetic oligonucleotide
ucgccuuuuuggagacaaaucccuuac

SEQ ID NO: 2067 - RNA, 27 nt, Artificial Sequence
  Synthetic oligonucleotide
cgccuuuuuggagacaaaucccuuacc

SEQ ID NO: 2068 - RNA, 27 nt, Artificial Sequence
  Synthetic oligonucleotide
gccuuuuuggagacaaaucccuuaccu

SEQ ID NO: 2069 - RNA, 27 nt, Artificial Sequence
  Synthetic oligonucleotide
ccuuuuuggagacaaaucccuuaccuu

SEQ ID NO: 2070 - RNA, 27 nt, Artificial Sequence
  Synthetic oligonucleotide
uuuggagacaaaucccuuaccuucaau

SEQ ID NO: 2071 - RNA, 27 nt, Artificial Sequence
  Synthetic oligonucleotide
uuggagacaaaucccuuaccuucaaug

SEQ ID NO: 2072 - RNA, 27 nt, Artificial Sequence
  Synthetic oligonucleotide
uggagacaaaucccuuaccuucaauga

SEQ ID NO: 2073 - RNA, 27 nt, Artificial Sequence
  Synthetic oligonucleotide
ggagacaaaucccuuaccuucaaugag

SEQ ID NO: 2074 - RNA, 27 nt, Artificial Sequence
  Synthetic oligonucleotide
gagacaaaucccuuaccuucaaugaga

SEQ ID NO: 2075 - RNA, 27 nt, Artificial Sequence
  Synthetic oligonucleotide
agacaaaucccuuaccuucaaugagac

SEQ ID NO: 2076 - RNA, 27 nt, Artificial Sequence
  Synthetic oligonucleotide
acaaaucccuuaccuucaaugagaccu

SEQ ID NO: 2077 - RNA, 27 nt, Artificial Sequence
  Synthetic oligonucleotide
caaaucccuuaccuucaaugagaccua

SEQ ID NO: 2078 - RNA, 27 nt, Artificial Sequence
  Synthetic oligonucleotide
aaaucccuuaccuucaaugagaccuac

SEQ ID NO: 2079 - RNA, 27 nt, Artificial Sequence
  Synthetic oligonucleotide
uuaccuucaaugagaccuaccaggaca

SEQ ID NO: 2080 - RNA, 27 nt, Artificial Sequence
  Synthetic oligonucleotide
cuucaaugagaccuaccaggacaucag

SEQ ID NO: 2081 - RNA, 27 nt, Artificial Sequence
  Synthetic oligonucleotide
uucaaugagaccuaccaggacaucagu

SEQ ID NO: 2082 - RNA, 27 nt, Artificial Sequence
  Synthetic oligonucleotide
ucaaugagaccuaccaggacaucagug

SEQ ID NO: 2083 - RNA, 27 nt, Artificial Sequence
  Synthetic oligonucleotide
aaugagaccuaccaggacaucagugag

SEQ ID NO: 2084 - RNA, 27 nt, Artificial Sequence
  Synthetic oligonucleotide
ugagaccuaccaggacaucagugaguu

SEQ ID NO: 2085 - RNA, 27 nt, Artificial Sequence
  Synthetic oligonucleotide
accuaccaggacaucagugaguuggua

SEQ ID NO: 2086 - RNA, 27 nt, Artificial Sequence
  Synthetic oligonucleotide
ccuaccaggacaucagugaguugguau

SEQ ID NO: 2087 - RNA, 27 nt, Artificial Sequence
  Synthetic oligonucleotide
cuaccaggacaucagugaguugguaua

SEQ ID NO: 2088 - RNA, 27 nt, Artificial Sequence
  Synthetic oligonucleotide
uaccaggacaucagugaguugguauau

SEQ ID NO: 2089 - RNA, 27 nt, Artificial Sequence
  Synthetic oligonucleotide
accaggacaucagugaguugguauaug

SEQ ID NO: 2090 - RNA, 27 nt, Artificial Sequence
  Synthetic oligonucleotide
ccaggacaucagugaguugguauaugg

SEQ ID NO: 2091 - RNA, 27 nt, Artificial Sequence
  Synthetic oligonucleotide
caggacaucagugaguugguauaugga

SEQ ID NO: 2092 - RNA, 27 nt, Artificial Sequence
  Synthetic oligonucleotide
aggacaucagugaguugguauauggag

SEQ ID NO: 2093 - RNA, 27 nt, Artificial Sequence
  Synthetic oligonucleotide
ggacaucagugaguugguauauggagc

SEQ ID NO: 2094 - RNA, 27 nt, Artificial Sequence
  Synthetic oligonucleotide
uauauggagccaagcuccagccccugg

SEQ ID NO: 2095 - RNA, 27 nt, Artificial Sequence
  Synthetic oligonucleotide
auauggagccaagcuccagccccugga

SEQ ID NO: 2096 - RNA, 27 nt, Artificial Sequence
  Synthetic oligonucleotide
uauggagccaagcuccagccccuggac

SEQ ID NO: 2097 - RNA, 27 nt, Artificial Sequence
  Synthetic oligonucleotide
auggagccaagcuccagccccuggacu

SEQ ID NO: 2098 - RNA, 27 nt, Artificial Sequence
  Synthetic oligonucleotide
uggagccaagcuccagccccuggacuu

SEQ ID NO: 2099 - RNA, 27 nt, Artificial Sequence
  Synthetic oligonucleotide
ggagccaagcuccagccccuggacuuc

SEQ ID NO: 2100 - RNA, 27 nt, Artificial Sequence
  Synthetic oligonucleotide
gagccaagcuccagccccuggacuuca

SEQ ID NO: 2101 - RNA, 27 nt, Artificial Sequence
  Synthetic oligonucleotide
agccaagcuccagccccuggacuucaa

SEQ ID NO: 2102 - RNA, 27 nt, Artificial Sequence
  Synthetic oligonucleotide
gccaagcuccagccccuggacuucaag

SEQ ID NO: 2103 - RNA, 27 nt, Artificial Sequence
  Synthetic oligonucleotide
ccaagcuccagccccuggacuucaagg

SEQ ID NO: 2104 - RNA, 27 nt, Artificial Sequence
  Synthetic oligonucleotide
caagcuccagccccuggacuucaagga

SEQ ID NO: 2105 - RNA, 27 nt, Artificial Sequence
  Synthetic oligonucleotide
aagcuccagccccuggacuucaaggaa

SEQ ID NO: 2106 - RNA, 27 nt, Artificial Sequence
  Synthetic oligonucleotide
agcuccagccccuggacuucaaggaaa

SEQ ID NO: 2107 - RNA, 27 nt, Artificial Sequence
  Synthetic oligonucleotide
gcuccagccccuggacuucaaggaaaa

SEQ ID NO: 2108 - RNA, 27 nt, Artificial Sequence
  Synthetic oligonucleotide
cuccagccccuggacuucaaggaaaau

SEQ ID NO: 2109 - RNA, 27 nt, Artificial Sequence
  Synthetic oligonucleotide
uccagccccuggacuucaaggaaaaug

SEQ ID NO: 2110 - RNA, 27 nt, Artificial Sequence
  Synthetic oligonucleotide
ccagccccuggacuucaaggaaaaugc

SEQ ID NO: 2111 - RNA, 27 nt, Artificial Sequence
  Synthetic oligonucleotide
cagccccuggacuucaaggaaaaugca

SEQ ID NO: 2112 - RNA, 27 nt, Artificial Sequence
  Synthetic oligonucleotide
ccuggacuucaaggaaaaugcagagca

SEQ ID NO: 2113 - RNA, 27 nt, Artificial Sequence
  Synthetic oligonucleotide
cuggacuucaaggaaaaugcagagcaa

SEQ ID NO: 2114 - RNA, 27 nt, Artificial Sequence
  Synthetic oligonucleotide
uggacuucaaggaaaaugcagagcaau

SEQ ID NO: 2115 - RNA, 27 nt, Artificial Sequence
  Synthetic oligonucleotide
ggacuucaaggaaaaugcagagcaauc

SEQ ID NO: 2116 - RNA, 27 nt, Artificial Sequence
  Synthetic oligonucleotide
acuucaaggaaaaugcagagcaaucca

SEQ ID NO: 2117 - RNA, 27 nt, Artificial Sequence
  Synthetic oligonucleotide
cuucaaggaaaaugcagagcaauccag

SEQ ID NO: 2118 - RNA, 27 nt, Artificial Sequence
  Synthetic oligonucleotide
uucaaggaaaaugcagagcaauccaga

SEQ ID NO: 2119 - RNA, 27 nt, Artificial Sequence
  Synthetic oligonucleotide
ucaaggaaaaugcagagcaauccagag

SEQ ID NO: 2120 - RNA, 27 nt, Artificial Sequence
  Synthetic oligonucleotide
gccaucaacaaauggguguccaauaag

SEQ ID NO: 2121 - RNA, 27 nt, Artificial Sequence
  Synthetic oligonucleotide
ccaucaacaaauggguguccaauaaga

SEQ ID NO: 2122 - RNA, 27 nt, Artificial Sequence
  Synthetic oligonucleotide
aacaaauggguguccaauaagaccgaa

SEQ ID NO: 2123 - RNA, 27 nt, Artificial Sequence
  Synthetic oligonucleotide
augagcucacuguucuggugcugguua

SEQ ID NO: 2124 - RNA, 27 nt, Artificial Sequence
  Synthetic oligonucleotide
gagcucacuguucuggugcugguuaac

SEQ ID NO: 2125 - RNA, 27 nt, Artificial Sequence
  Synthetic oligonucleotide
agcucacuguucuggugcugguuaaca

SEQ ID NO: 2126 - RNA, 27 nt, Artificial Sequence
  Synthetic oligonucleotide
gcucacuguucuggugcugguuaacac

SEQ ID NO: 2127 - RNA, 27 nt, Artificial Sequence
  Synthetic oligonucleotide
cucacuguucuggugcugguuaacacc

SEQ ID NO: 2128 - RNA, 27 nt, Artificial Sequence
  Synthetic oligonucleotide
ucacuguucuggugcugguuaacacca

SEQ ID NO: 2129 - RNA, 27 nt, Artificial Sequence
  Synthetic oligonucleotide
cacuguucuggugcugguuaacaccau

SEQ ID NO: 2130 - RNA, 27 nt, Artificial Sequence
  Synthetic oligonucleotide
acuguucuggugcugguuaacaccauu

SEQ ID NO: 2131 - RNA, 27 nt, Artificial Sequence
  Synthetic oligonucleotide
cuguucuggugcugguuaacaccauuu

SEQ ID NO: 2132 - RNA, 27 nt, Artificial Sequence
  Synthetic oligonucleotide
uguucuggugcugguuaacaccauuua

SEQ ID NO: 2133 - RNA, 27 nt, Artificial Sequence
  Synthetic oligonucleotide
guucuggugcugguuaacaccauuuac

SEQ ID NO: 2134 - RNA, 27 nt, Artificial Sequence
  Synthetic oligonucleotide
uucuggugcugguuaacaccauuuacu

SEQ ID NO: 2135 - RNA, 27 nt, Artificial Sequence
  Synthetic oligonucleotide
ucuggugcugguuaacaccauuuacuu

SEQ ID NO: 2136 - RNA, 27 nt, Artificial Sequence
  Synthetic oligonucleotide
cuggugcugguuaacaccauuuacuuc

SEQ ID NO: 2137 - RNA, 27 nt, Artificial Sequence
  Synthetic oligonucleotide
uggugcugguuaacaccauuuacuuca

SEQ ID NO: 2138 - RNA, 27 nt, Artificial Sequence
  Synthetic oligonucleotide
ggugcugguuaacaccauuuacuucaa

SEQ ID NO: 2139 - RNA, 27 nt, Artificial Sequence
  Synthetic oligonucleotide
gugcugguuaacaccauuuacuucaag

SEQ ID NO: 2140 - RNA, 27 nt, Artificial Sequence
  Synthetic oligonucleotide
ugcugguuaacaccauuuacuucaagg

SEQ ID NO: 2141 - RNA, 27 nt, Artificial Sequence
  Synthetic oligonucleotide
gcugguuaacaccauuuacuucaaggg

SEQ ID NO: 2142 - RNA, 27 nt, Artificial Sequence
  Synthetic oligonucleotide
cugguuaacaccauuuacuucaagggc

SEQ ID NO: 2143 - RNA, 27 nt, Artificial Sequence
  Synthetic oligonucleotide
ugguuaacaccauuuacuucaagggcc

SEQ ID NO: 2144 - RNA, 27 nt, Artificial Sequence
  Synthetic oligonucleotide
gguuaacaccauuuacuucaagggccu

SEQ ID NO: 2145 - RNA, 27 nt, Artificial Sequence
  Synthetic oligonucleotide
guuaacaccauuuacuucaagggccug

SEQ ID NO: 2146 - RNA, 27 nt, Artificial Sequence
  Synthetic oligonucleotide
uuaacaccauuuacuucaagggccugu

SEQ ID NO: 2147 - RNA, 27 nt, Artificial Sequence
  Synthetic oligonucleotide
uaacaccauuuacuucaagggccugug

SEQ ID NO: 2148 - RNA, 27 nt, Artificial Sequence
  Synthetic oligonucleotide
aacaccauuuacuucaagggccugugg

SEQ ID NO: 2149 - RNA, 27 nt, Artificial Sequence
  Synthetic oligonucleotide
acaccauuuacuucaagggccugugga

SEQ ID NO: 2150 - RNA, 27 nt, Artificial Sequence
  Synthetic oligonucleotide
caccauuuacuucaagggccuguggaa

SEQ ID NO: 2151 - RNA, 27 nt, Artificial Sequence
  Synthetic oligonucleotide
accauuuacuucaagggccuguggaag

SEQ ID NO: 2152 - RNA, 27 nt, Artificial Sequence
  Synthetic oligonucleotide
ccauuuacuucaagggccuguggaagu

SEQ ID NO: 2153 - RNA, 27 nt, Artificial Sequence
  Synthetic oligonucleotide
cauuuacuucaagggccuguggaaguc

SEQ ID NO: 2154 - RNA, 27 nt, Artificial Sequence
  Synthetic oligonucleotide
auuuacuucaagggccuguggaaguca

SEQ ID NO: 2155 - RNA, 27 nt, Artificial Sequence
  Synthetic oligonucleotide
uuuacuucaagggccuguggaagucaa

SEQ ID NO: 2156 - RNA, 27 nt, Artificial Sequence
  Synthetic oligonucleotide
uuacuucaagggccuguggaagucaaa

SEQ ID NO: 2157 - RNA, 27 nt, Artificial Sequence
  Synthetic oligonucleotide
uacuucaagggccuguggaagucaaag

SEQ ID NO: 2158 - RNA, 27 nt, Artificial Sequence
  Synthetic oligonucleotide
acuucaagggccuguggaagucaaagu

SEQ ID NO: 2159 - RNA, 27 nt, Artificial Sequence
  Synthetic oligonucleotide
cuucaagggccuguggaagucaaaguu

SEQ ID NO: 2160 - RNA, 27 nt, Artificial Sequence
  Synthetic oligonucleotide
uucaagggccuguggaagucaaaguuc

SEQ ID NO: 2161 - RNA, 27 nt, Artificial Sequence
  Synthetic oligonucleotide
ucaagggccuguggaagucaaaguuca

SEQ ID NO: 2162 - RNA, 27 nt, Artificial Sequence
  Synthetic oligonucleotide
caagggccuguggaagucaaaguucag

SEQ ID NO: 2163 - RNA, 27 nt, Artificial Sequence
  Synthetic oligonucleotide
aagggccuguggaagucaaaguucagc

SEQ ID NO: 2164 - RNA, 27 nt, Artificial Sequence
  Synthetic oligonucleotide
agggccuguggaagucaaaguucagcc

SEQ ID NO: 2165 - RNA, 27 nt, Artificial Sequence
  Synthetic oligonucleotide
gggccuguggaagucaaaguucagccc

SEQ ID NO: 2166 - RNA, 27 nt, Artificial Sequence
  Synthetic oligonucleotide
ggccuguggaagucaaaguucagcccu

SEQ ID NO: 2167 - RNA, 27 nt, Artificial Sequence
  Synthetic oligonucleotide
gccuguggaagucaaaguucagcccug

SEQ ID NO: 2168 - RNA, 27 nt, Artificial Sequence
  Synthetic oligonucleotide
ccuguggaagucaaaguucagcccuga

SEQ ID NO: 2169 - RNA, 27 nt, Artificial Sequence
  Synthetic oligonucleotide
cuguggaagucaaaguucagcccugag

SEQ ID NO: 2170 - RNA, 27 nt, Artificial Sequence
  Synthetic oligonucleotide
uguggaagucaaaguucagcccugaga

SEQ ID NO: 2171 - RNA, 27 nt, Artificial Sequence
  Synthetic oligonucleotide
guggaagucaaaguucagcccugagaa

SEQ ID NO: 2172 - RNA, 27 nt, Artificial Sequence
  Synthetic oligonucleotide
uggaagucaaaguucagcccugagaac

SEQ ID NO: 2173 - RNA, 27 nt, Artificial Sequence
  Synthetic oligonucleotide
ggaagucaaaguucagcccugagaaca

SEQ ID NO: 2174 - RNA, 27 nt, Artificial Sequence
  Synthetic oligonucleotide
gaagucaaaguucagcccugagaacac

SEQ ID NO: 2175 - RNA, 27 nt, Artificial Sequence
  Synthetic oligonucleotide
uacaaggcugauggagagucguguuca

SEQ ID NO: 2176 - RNA, 27 nt, Artificial Sequence
  Synthetic oligonucleotide
cugauggagagucguguucagcaucua

SEQ ID NO: 2177 - RNA, 27 nt, Artificial Sequence
  Synthetic oligonucleotide
ugauggagagucguguucagcaucuau

SEQ ID NO: 2178 - RNA, 27 nt, Artificial Sequence
  Synthetic oligonucleotide
aucuaugauguaccaggaaggcaaguu

SEQ ID NO: 2179 - RNA, 27 nt, Artificial Sequence
  Synthetic oligonucleotide
ucuaugauguaccaggaaggcaaguuc

SEQ ID NO: 2180 - RNA, 27 nt, Artificial Sequence
  Synthetic oligonucleotide
cuaugauguaccaggaaggcaaguucc

SEQ ID NO: 2181 - RNA, 27 nt, Artificial Sequence
  Synthetic oligonucleotide
uaugauguaccaggaaggcaaguuccg

SEQ ID NO: 2182 - RNA, 27 nt, Artificial Sequence
  Synthetic oligonucleotide
ugauguaccaggaaggcaaguuccguu

SEQ ID NO: 2183 - RNA, 27 nt, Artificial Sequence
  Synthetic oligonucleotide
acccaggugcuugaguugcccuucaaa

SEQ ID NO: 2184 - RNA, 27 nt, Artificial Sequence
  Synthetic oligonucleotide
caggugcuugaguugcccuucaaaggu

SEQ ID NO: 2185 - RNA, 27 nt, Artificial Sequence
  Synthetic oligonucleotide
aggugcuugaguugcccuucaaaggug

SEQ ID NO: 2186 - RNA, 27 nt, Artificial Sequence
  Synthetic oligonucleotide
ggugcuugaguugcccuucaaagguga

SEQ ID NO: 2187 - RNA, 27 nt, Artificial Sequence
  Synthetic oligonucleotide
aaggugaugacaucaccaugguccuca

SEQ ID NO: 2188 - RNA, 27 nt, Artificial Sequence
  Synthetic oligonucleotide
aggugaugacaucaccaugguccucau

SEQ ID NO: 2189 - RNA, 27 nt, Artificial Sequence
  Synthetic oligonucleotide
cuugcccaagccugagaagagccuggc

SEQ ID NO: 2190 - RNA, 27 nt, Artificial Sequence
  Synthetic oligonucleotide
uugcccaagccugagaagagccuggcc

SEQ ID NO: 2191 - RNA, 27 nt, Artificial Sequence
  Synthetic oligonucleotide
ugcccaagccugagaagagccuggcca

SEQ ID NO: 2192 - RNA, 27 nt, Artificial Sequence
  Synthetic oligonucleotide
gcccaagccugagaagagccuggccaa

SEQ ID NO: 2193 - RNA, 27 nt, Artificial Sequence
  Synthetic oligonucleotide
cccaagccugagaagagccuggccaag

SEQ ID NO: 2194 - RNA, 27 nt, Artificial Sequence
  Synthetic oligonucleotide
ccaagccugagaagagccuggccaagg

SEQ ID NO: 2195 - RNA, 27 nt, Artificial Sequence
  Synthetic oligonucleotide
caagccugagaagagccuggccaaggu

SEQ ID NO: 2196 - RNA, 27 nt, Artificial Sequence
  Synthetic oligonucleotide
aagccugagaagagccuggccaaggua

SEQ ID NO: 2197 - RNA, 27 nt, Artificial Sequence
  Synthetic oligonucleotide
agccugagaagagccuggccaagguag

SEQ ID NO: 2198 - RNA, 27 nt, Artificial Sequence
  Synthetic oligonucleotide
gccugagaagagccuggccaagguaga

SEQ ID NO: 2199 - RNA, 27 nt, Artificial Sequence
  Synthetic oligonucleotide
ccugagaagagccuggccaagguagag

SEQ ID NO: 2200 - RNA, 27 nt, Artificial Sequence
  Synthetic oligonucleotide
cugagaagagccuggccaagguagaga

SEQ ID NO: 2201 - RNA, 27 nt, Artificial Sequence
  Synthetic oligonucleotide
ugagaagagccuggccaagguagagaa

SEQ ID NO: 2202 - RNA, 27 nt, Artificial Sequence
  Synthetic oligonucleotide
uggugguccacaugccccgcuuccgca

SEQ ID NO: 2203 - RNA, 27 nt, Artificial Sequence
  Synthetic oligonucleotide
ggugguccacaugccccgcuuccgcau

SEQ ID NO: 2204 - RNA, 27 nt, Artificial Sequence
  Synthetic oligonucleotide
gugguccacaugccccgcuuccgcauu

SEQ ID NO: 2205 - RNA, 27 nt, Artificial Sequence
  Synthetic oligonucleotide
ugguccacaugccccgcuuccgcauug

SEQ ID NO: 2206 - RNA, 27 nt, Artificial Sequence
  Synthetic oligonucleotide
gguccacaugccccgcuuccgcauuga

SEQ ID NO: 2207 - RNA, 27 nt, Artificial Sequence
  Synthetic oligonucleotide
guccacaugccccgcuuccgcauugag

SEQ ID NO: 2208 - RNA, 27 nt, Artificial Sequence
  Synthetic oligonucleotide
uccacaugccccgcuuccgcauugagg

SEQ ID NO: 2209 - RNA, 27 nt, Artificial Sequence
  Synthetic oligonucleotide
ucaguuugaaggagcagcugcaagaca

SEQ ID NO: 2210 - RNA, 27 nt, Artificial Sequence
  Synthetic oligonucleotide
caguuugaaggagcagcugcaagacau

SEQ ID NO: 2211 - RNA, 27 nt, Artificial Sequence
  Synthetic oligonucleotide
uuugaaggagcagcugcaagacauggg

SEQ ID NO: 2212 - RNA, 27 nt, Artificial Sequence
  Synthetic oligonucleotide
uugaaggagcagcugcaagacaugggc

SEQ ID NO: 2213 - RNA, 27 nt, Artificial Sequence
  Synthetic oligonucleotide
ugaaggagcagcugcaagacaugggcc

SEQ ID NO: 2214 - RNA, 27 nt, Artificial Sequence
  Synthetic oligonucleotide
gaaggagcagcugcaagacaugggccu

SEQ ID NO: 2215 - RNA, 27 nt, Artificial Sequence
  Synthetic oligonucleotide
aaggagcagcugcaagacaugggccuu

SEQ ID NO: 2216 - RNA, 27 nt, Artificial Sequence
  Synthetic oligonucleotide
aggagcagcugcaagacaugggccuug

SEQ ID NO: 2217 - RNA, 27 nt, Artificial Sequence
  Synthetic oligonucleotide
ggagcagcugcaagacaugggccuugu

SEQ ID NO: 2218 - RNA, 27 nt, Artificial Sequence
  Synthetic oligonucleotide
gagcagcugcaagacaugggccuuguc

SEQ ID NO: 2219 - RNA, 27 nt, Artificial Sequence
  Synthetic oligonucleotide
agcagcugcaagacaugggccuugucg

SEQ ID NO: 2220 - RNA, 27 nt, Artificial Sequence
  Synthetic oligonucleotide
gcagcugcaagacaugggccuugucga

SEQ ID NO: 2221 - RNA, 27 nt, Artificial Sequence
  Synthetic oligonucleotide
ccuugucgaucuguucagcccugaaaa

SEQ ID NO: 2222 - RNA, 27 nt, Artificial Sequence
  Synthetic oligonucleotide
uugucgaucuguucagcccugaaaagu

SEQ ID NO: 2223 - RNA, 27 nt, Artificial Sequence
  Synthetic oligonucleotide
ugucgaucuguucagcccugaaaaguc

SEQ ID NO: 2224 - RNA, 27 nt, Artificial Sequence
  Synthetic oligonucleotide
ucgaucuguucagcccugaaaagucca

SEQ ID NO: 2225 - RNA, 27 nt, Artificial Sequence
  Synthetic oligonucleotide
aucuguucagcccugaaaaguccaaac

SEQ ID NO: 2226 - RNA, 27 nt, Artificial Sequence
  Synthetic oligonucleotide
cuguucagcccugaaaaguccaaacuc

SEQ ID NO: 2227 - RNA, 27 nt, Artificial Sequence
  Synthetic oligonucleotide
gaaaaguccaaacucccagguauuguu

SEQ ID NO: 2228 - RNA, 27 nt, Artificial Sequence
  Synthetic oligonucleotide
aaaaguccaaacucccagguauuguug

SEQ ID NO: 2229 - RNA, 27 nt, Artificial Sequence
  Synthetic oligonucleotide
aaguccaaacucccagguauuguugca

SEQ ID NO: 2230 - RNA, 27 nt, Artificial Sequence
  Synthetic oligonucleotide
guccaaacucccagguauuguugcaga

SEQ ID NO: 2231 - RNA, 27 nt, Artificial Sequence
  Synthetic oligonucleotide
uccaaacucccagguauuguugcagaa

SEQ ID NO: 2232 - RNA, 27 nt, Artificial Sequence
  Synthetic oligonucleotide
ccaaacucccagguauuguugcagaag

SEQ ID NO: 2233 - RNA, 27 nt, Artificial Sequence
  Synthetic oligonucleotide
caaacucccagguauuguugcagaagg

SEQ ID NO: 2234 - RNA, 27 nt, Artificial Sequence
  Synthetic oligonucleotide
uccauaaggcauuucuugagguaaaug

SEQ ID NO: 2235 - RNA, 27 nt, Artificial Sequence
  Synthetic oligonucleotide
ccauaaggcauuucuugagguaaauga

SEQ ID NO: 2236 - RNA, 27 nt, Artificial Sequence
  Synthetic oligonucleotide
cauaaggcauuucuugagguaaaugaa

SEQ ID NO: 2237 - RNA, 27 nt, Artificial Sequence
  Synthetic oligonucleotide
auaaggcauuucuugagguaaaugaag

SEQ ID NO: 2238 - RNA, 27 nt, Artificial Sequence
  Synthetic oligonucleotide
uaaggcauuucuugagguaaaugaaga

SEQ ID NO: 2239 - RNA, 27 nt, Artificial Sequence
  Synthetic oligonucleotide
aaggcauuucuugagguaaaugaagaa

SEQ ID NO: 2240 - RNA, 27 nt, Artificial Sequence
  Synthetic oligonucleotide
aggcauuucuugagguaaaugaagaag

SEQ ID NO: 2241 - RNA, 27 nt, Artificial Sequence
  Synthetic oligonucleotide
ggcauuucuugagguaaaugaagaagg

SEQ ID NO: 2242 - RNA, 27 nt, Artificial Sequence
  Synthetic oligonucleotide
cuugagguaaaugaagaaggcagugaa

SEQ ID NO: 2243 - RNA, 27 nt, Artificial Sequence
  Synthetic oligonucleotide
uugagguaaaugaagaaggcagugaag

SEQ ID NO: 2244 - RNA, 27 nt, Artificial Sequence
  Synthetic oligonucleotide
ugagguaaaugaagaaggcagugaagc

SEQ ID NO: 2245 - RNA, 27 nt, Artificial Sequence
  Synthetic oligonucleotide
gagguaaaugaagaaggcagugaagca

SEQ ID NO: 2246 - RNA, 27 nt, Artificial Sequence
  Synthetic oligonucleotide
agguaaaugaagaaggcagugaagcag

SEQ ID NO: 2247 - RNA, 27 nt, Artificial Sequence
  Synthetic oligonucleotide
gguaaaugaagaaggcagugaagcagc

SEQ ID NO: 2248 - RNA, 27 nt, Artificial Sequence
  Synthetic oligonucleotide
guaaaugaagaaggcagugaagcagcu

SEQ ID NO: 2249 - RNA, 27 nt, Artificial Sequence
  Synthetic oligonucleotide
ugaagaaggcagugaagcagcugcaag

SEQ ID NO: 2250 - RNA, 27 nt, Artificial Sequence
  Synthetic oligonucleotide
agaaggcagugaagcagcugcaaguac

SEQ ID NO: 2251 - RNA, 27 nt, Artificial Sequence
  Synthetic oligonucleotide
gaaggcagugaagcagcugcaaguacc

SEQ ID NO: 2252 - RNA, 27 nt, Artificial Sequence
  Synthetic oligonucleotide
ugaagcagcugcaaguaccgcuguugu

SEQ ID NO: 2253 - RNA, 27 nt, Artificial Sequence
  Synthetic oligonucleotide
ccaacaggccuuuccugguuuuuauaa

SEQ ID NO: 2254 - RNA, 27 nt, Artificial Sequence
  Synthetic oligonucleotide
caacaggccuuuccugguuuuuauaag

SEQ ID NO: 2255 - RNA, 27 nt, Artificial Sequence
  Synthetic oligonucleotide
aacaggccuuuccugguuuuuauaaga

SEQ ID NO: 2256 - RNA, 27 nt, Artificial Sequence
  Synthetic oligonucleotide
acaggccuuuccugguuuuuauaagag

SEQ ID NO: 2257 - RNA, 27 nt, Artificial Sequence
  Synthetic oligonucleotide
caggccuuuccugguuuuuauaagaga

SEQ ID NO: 2258 - RNA, 27 nt, Artificial Sequence
  Synthetic oligonucleotide
aggccuuuccugguuuuuauaagagaa

SEQ ID NO: 2259 - RNA, 27 nt, Artificial Sequence
  Synthetic oligonucleotide
gccuuuccugguuuuuauaagagaagu

SEQ ID NO: 2260 - RNA, 27 nt, Artificial Sequence
  Synthetic oligonucleotide
ccuuuccugguuuuuauaagagaaguu

SEQ ID NO: 2261 - RNA, 27 nt, Artificial Sequence
  Synthetic oligonucleotide
cuuuccugguuuuuauaagagaaguuc

SEQ ID NO: 2262 - RNA, 27 nt, Artificial Sequence
  Synthetic oligonucleotide
uuuccugguuuuuauaagagaaguucc

SEQ ID NO: 2263 - RNA, 27 nt, Artificial Sequence
  Synthetic oligonucleotide
uuccugguuuuuauaagagaaguuccu

SEQ ID NO: 2264 - RNA, 27 nt, Artificial Sequence
  Synthetic oligonucleotide
uccugguuuuuauaagagaaguuccuc

SEQ ID NO: 2265 - RNA, 27 nt, Artificial Sequence
  Synthetic oligonucleotide
ccugguuuuuauaagagaaguuccucu

SEQ ID NO: 2266 - RNA, 27 nt, Artificial Sequence
  Synthetic oligonucleotide
cugguuuuuauaagagaaguuccucug

SEQ ID NO: 2267 - RNA, 27 nt, Artificial Sequence
  Synthetic oligonucleotide
ugguuuuuauaagagaaguuccucuga

SEQ ID NO: 2268 - RNA, 27 nt, Artificial Sequence
  Synthetic oligonucleotide
gguuuuuauaagagaaguuccucugaa

SEQ ID NO: 2269 - RNA, 27 nt, Artificial Sequence
  Synthetic oligonucleotide
guuuuuauaagagaaguuccucugaac

SEQ ID NO: 2270 - RNA, 27 nt, Artificial Sequence
  Synthetic oligonucleotide
uuuuuauaagagaaguuccucugaaca

SEQ ID NO: 2271 - RNA, 27 nt, Artificial Sequence
  Synthetic oligonucleotide
uuuuauaagagaaguuccucugaacac

SEQ ID NO: 2272 - RNA, 27 nt, Artificial Sequence
  Synthetic oligonucleotide
uuuauaagagaaguuccucugaacacu

SEQ ID NO: 2273 - RNA, 27 nt, Artificial Sequence
  Synthetic oligonucleotide
uuauaagagaaguuccucugaacacua

SEQ ID NO: 2274 - RNA, 27 nt, Artificial Sequence
  Synthetic oligonucleotide
uauaagagaaguuccucugaacacuau

SEQ ID NO: 2275 - RNA, 27 nt, Artificial Sequence
  Synthetic oligonucleotide
auaagagaaguuccucugaacacuauu

SEQ ID NO: 2276 - RNA, 27 nt, Artificial Sequence
  Synthetic oligonucleotide
uaagagaaguuccucugaacacuauua

SEQ ID NO: 2277 - RNA, 27 nt, Artificial Sequence
  Synthetic oligonucleotide
aagagaaguuccucugaacacuauuau

SEQ ID NO: 2278 - RNA, 27 nt, Artificial Sequence
  Synthetic oligonucleotide
agagaaguuccucugaacacuauuauc

SEQ ID NO: 2279 - RNA, 27 nt, Artificial Sequence
  Synthetic oligonucleotide
gagaaguuccucugaacacuauuaucu

SEQ ID NO: 2280 - RNA, 27 nt, Artificial Sequence
  Synthetic oligonucleotide
agaaguuccucugaacacuauuaucuu

SEQ ID NO: 2281 - RNA, 27 nt, Artificial Sequence
  Synthetic oligonucleotide
gaaguuccucugaacacuauuaucuuc

SEQ ID NO: 2282 - RNA, 27 nt, Artificial Sequence
  Synthetic oligonucleotide
aaguuccucugaacacuauuaucuuca

SEQ ID NO: 2283 - RNA, 27 nt, Artificial Sequence
  Synthetic oligonucleotide
aguuccucugaacacuauuaucuucau

SEQ ID NO: 2284 - RNA, 27 nt, Artificial Sequence
  Synthetic oligonucleotide
guuccucugaacacuauuaucuucaug

SEQ ID NO: 2285 - RNA, 27 nt, Artificial Sequence
  Synthetic oligonucleotide
uuccucugaacacuauuaucuucaugg

SEQ ID NO: 2286 - RNA, 27 nt, Artificial Sequence
  Synthetic oligonucleotide
uccucugaacacuauuaucuucauggg

SEQ ID NO: 2287 - RNA, 27 nt, Artificial Sequence
  Synthetic oligonucleotide
cucugaacacuauuaucuucaugggca

SEQ ID NO: 2288 - RNA, 27 nt, Artificial Sequence
  Synthetic oligonucleotide
aacacuauuaucuucaugggcagagua

SEQ ID NO: 2289 - RNA, 27 nt, Artificial Sequence
  Synthetic oligonucleotide
acagaaguaaaaauaaauacaaacuac

SEQ ID NO: 2290 - RNA, 27 nt, Artificial Sequence
  Synthetic oligonucleotide
cagaaguaaaaauaaauacaaacuacu

SEQ ID NO: 2291 - RNA, 27 nt, Artificial Sequence
  Synthetic oligonucleotide
guggugagauauaagacauaaucagaa

SEQ ID NO: 2292 - RNA, 27 nt, Artificial Sequence
  Synthetic oligonucleotide
caagcagcugauggagguuuuuaaauu

SEQ ID NO: 2293 - RNA, 27 nt, Artificial Sequence
  Synthetic oligonucleotide
ugauggagguuuuuaaauuugauacca

SEQ ID NO: 2294 - RNA, 27 nt, Artificial Sequence
  Synthetic oligonucleotide
agggaaguugcacugaacacuauuaua

SEQ ID NO: 2295 - RNA, 27 nt, Artificial Sequence
  Synthetic oligonucleotide
gaaguugcacugaacacuauuauauuc

SEQ ID NO: 2296 - RNA, 27 nt, Artificial Sequence
  Synthetic oligonucleotide
aguugcacugaacacuauuauauucau

SEQ ID NO: 2297 - RNA, 27 nt, Artificial Sequence
  Synthetic oligonucleotide
uacuuugguguuugugaauagaaguaa

SEQ ID NO: 2298 - RNA, 27 nt, Artificial Sequence
  Synthetic oligonucleotide
uugguguuugugaauagaaguaaaaau

SEQ ID NO: 2299 - RNA, 27 nt, Artificial Sequence
  Synthetic oligonucleotide
ugguguuugugaauagaaguaaaaaua

SEQ ID NO: 2300 - RNA, 27 nt, Artificial Sequence
  Synthetic oligonucleotide
gguguuugugaauagaaguaaaaauaa

SEQ ID NO: 2301 - RNA, 27 nt, Artificial Sequence
  Synthetic oligonucleotide
guguuugugaauagaaguaaaaauaaa

SEQ ID NO: 2302 - RNA, 27 nt, Artificial Sequence
  Synthetic oligonucleotide
uugugaauagaaguaaaaauaaauacg

SEQ ID NO: 2303 - RNA, 27 nt, Artificial Sequence
  Synthetic oligonucleotide
acaagagguaaauauauuacuauuuca

SEQ ID NO: 2304 - RNA, 27 nt, Artificial Sequence
  Synthetic oligonucleotide
agagaaaugcauuuuuauacaaaaaaa

SEQ ID NO: 2305 - RNA, 19 nt, Artificial Sequence
  Synthetic oligonucleotide
ccauguauuccaaugugau

SEQ ID NO: 2306 - RNA, 19 nt, Artificial Sequence
  Synthetic oligonucleotide
cauguauuccaaugugaua

SEQ ID NO: 2307 - RNA, 19 nt, Artificial Sequence
  Synthetic oligonucleotide
auguauuccaaugugauag

SEQ ID NO: 2308 - RNA, 19 nt, Artificial Sequence
  Synthetic oligonucleotide
uguauuccaaugugauagg

SEQ ID NO: 2309 - RNA, 19 nt, Artificial Sequence
  Synthetic oligonucleotide
guauuccaaugugauagga

SEQ ID NO: 2310 - RNA, 19 nt, Artificial Sequence
  Synthetic oligonucleotide
uauuccaaugugauaggaa

SEQ ID NO: 2311 - RNA, 19 nt, Artificial Sequence
  Synthetic oligonucleotide
auuccaaugugauaggaac

SEQ ID NO: 2312 - RNA, 19 nt, Artificial Sequence
  Synthetic oligonucleotide
cucuggaaaaaggaagguu

SEQ ID NO: 2313 - RNA, 19 nt, Artificial Sequence
  Synthetic oligonucleotide
ucuggaaaaaggaagguuu

SEQ ID NO: 2314 - RNA, 19 nt, Artificial Sequence
  Synthetic oligonucleotide
cuggaaaaaggaagguuua

SEQ ID NO: 2315 - RNA, 19 nt, Artificial Sequence
  Synthetic oligonucleotide
ggaaaaaggaagguuuauc

SEQ ID NO: 2316 - RNA, 19 nt, Artificial Sequence
  Synthetic oligonucleotide
gaaaaaggaagguuuaucu

SEQ ID NO: 2317 - RNA, 19 nt, Artificial Sequence
  Synthetic oligonucleotide
aaaaaggaagguuuaucuu

SEQ ID NO: 2318 - RNA, 19 nt, Artificial Sequence
  Synthetic oligonucleotide
ucccaugaaucccaugugc

SEQ ID NO: 2319 - RNA, 19 nt, Artificial Sequence
  Synthetic oligonucleotide
cccaugaaucccaugugca

SEQ ID NO: 2320 - RNA, 19 nt, Artificial Sequence
  Synthetic oligonucleotide
augaaucccaugugcauuu

SEQ ID NO: 2321 - RNA, 19 nt, Artificial Sequence
  Synthetic oligonucleotide
ugugcauuuaccgcucccc

SEQ ID NO: 2322 - RNA, 19 nt, Artificial Sequence
  Synthetic oligonucleotide
gucugggaacuguccaagg

SEQ ID NO: 2323 - RNA, 19 nt, Artificial Sequence
  Synthetic oligonucleotide
ucugggaacuguccaaggc

SEQ ID NO: 2324 - RNA, 19 nt, Artificial Sequence
  Synthetic oligonucleotide
cugggaacuguccaaggcc

SEQ ID NO: 2325 - RNA, 19 nt, Artificial Sequence
  Synthetic oligonucleotide
ugggaacuguccaaggcca

SEQ ID NO: 2326 - RNA, 19 nt, Artificial Sequence
  Synthetic oligonucleotide
gggaacuguccaaggccaa

SEQ ID NO: 2327 - RNA, 19 nt, Artificial Sequence
  Synthetic oligonucleotide
ggaacuguccaaggccaau

SEQ ID NO: 2328 - RNA, 19 nt, Artificial Sequence
  Synthetic oligonucleotide
gaacuguccaaggccaauu

SEQ ID NO: 2329 - RNA, 19 nt, Artificial Sequence
  Synthetic oligonucleotide
aacuguccaaggccaauuc

SEQ ID NO: 2330 - RNA, 19 nt, Artificial Sequence
  Synthetic oligonucleotide
auucccgcuuugcuaccac

SEQ ID NO: 2331 - RNA, 19 nt, Artificial Sequence
  Synthetic oligonucleotide
cccgcuuugcuaccacuuu

SEQ ID NO: 2332 - RNA, 19 nt, Artificial Sequence
  Synthetic oligonucleotide
ccgcuuugcuaccacuuuc

SEQ ID NO: 2333 - RNA, 19 nt, Artificial Sequence
  Synthetic oligonucleotide
cgcuuugcuaccacuuucu

SEQ ID NO: 2334 - RNA, 19 nt, Artificial Sequence
  Synthetic oligonucleotide
gcuuugcuaccacuuucua

SEQ ID NO: 2335 - RNA, 19 nt, Artificial Sequence
  Synthetic oligonucleotide
cuuugcuaccacuuucuau

SEQ ID NO: 2336 - RNA, 19 nt, Artificial Sequence
  Synthetic oligonucleotide
uuugcuaccacuuucuauc

SEQ ID NO: 2337 - RNA, 19 nt, Artificial Sequence
  Synthetic oligonucleotide
uugcuaccacuuucuauca

SEQ ID NO: 2338 - RNA, 19 nt, Artificial Sequence
  Synthetic oligonucleotide
ugcuaccacuuucuaucag

SEQ ID NO: 2339 - RNA, 19 nt, Artificial Sequence
  Synthetic oligonucleotide
gcuaccacuuucuaucagc

SEQ ID NO: 2340 - RNA, 19 nt, Artificial Sequence
  Synthetic oligonucleotide
accuggcagauuccaagaa

SEQ ID NO: 2341 - RNA, 19 nt, Artificial Sequence
  Synthetic oligonucleotide
gauaacauuuuccugucac

SEQ ID NO: 2342 - RNA, 19 nt, Artificial Sequence
  Synthetic oligonucleotide
aacauuuuccugucacccc

SEQ ID NO: 2343 - RNA, 19 nt, Artificial Sequence
  Synthetic oligonucleotide
cauuuuccugucaccccug

SEQ ID NO: 2344 - RNA, 19 nt, Artificial Sequence
  Synthetic oligonucleotide
gcuuuugcuaugaccaagc

SEQ ID NO: 2345 - RNA, 19 nt, Artificial Sequence
  Synthetic oligonucleotide
cuuuugcuaugaccaagcu

SEQ ID NO: 2346 - RNA, 19 nt, Artificial Sequence
  Synthetic oligonucleotide
uuuugcuaugaccaagcug

SEQ ID NO: 2347 - RNA, 19 nt, Artificial Sequence
  Synthetic oligonucleotide
uuugcuaugaccaagcugg

SEQ ID NO: 2348 - RNA, 19 nt, Artificial Sequence
  Synthetic oligonucleotide
uugcuaugaccaagcuggg

SEQ ID NO: 2349 - RNA, 19 nt, Artificial Sequence
  Synthetic oligonucleotide
ugcuaugaccaagcugggu

SEQ ID NO: 2350 - RNA, 19 nt, Artificial Sequence
  Synthetic oligonucleotide
gcuaugaccaagcugggug

SEQ ID NO: 2351 - RNA, 19 nt, Artificial Sequence
  Synthetic oligonucleotide
cuaugaccaagcugggugc

SEQ ID NO: 2352 - RNA, 19 nt, Artificial Sequence
  Synthetic oligonucleotide
uaugaccaagcugggugcc

SEQ ID NO: 2353 - RNA, 19 nt, Artificial Sequence
  Synthetic oligonucleotide
augaccaagcugggugccu

SEQ ID NO: 2354 - RNA, 19 nt, Artificial Sequence
  Synthetic oligonucleotide
ugaccaagcugggugccug

SEQ ID NO: 2355 - RNA, 19 nt, Artificial Sequence
  Synthetic oligonucleotide
gaccaagcugggugccugu

SEQ ID NO: 2356 - RNA, 19 nt, Artificial Sequence
  Synthetic oligonucleotide
accaagcugggugccugua

SEQ ID NO: 2357 - RNA, 19 nt, Artificial Sequence
  Synthetic oligonucleotide
ccaagcugggugccuguaa

SEQ ID NO: 2358 - RNA, 19 nt, Artificial Sequence
  Synthetic oligonucleotide
agcaacugauggagguauu

SEQ ID NO: 2359 - RNA, 19 nt, Artificial Sequence
  Synthetic oligonucleotide
gcaacugauggagguauuu

SEQ ID NO: 2360 - RNA, 19 nt, Artificial Sequence
  Synthetic oligonucleotide
caacugauggagguauuua

SEQ ID NO: 2361 - RNA, 19 nt, Artificial Sequence
  Synthetic oligonucleotide
aacugauggagguauuuaa

SEQ ID NO: 2362 - RNA, 19 nt, Artificial Sequence
  Synthetic oligonucleotide
acugauggagguauuuaag

SEQ ID NO: 2363 - RNA, 19 nt, Artificial Sequence
  Synthetic oligonucleotide
cugauggagguauuuaagu

SEQ ID NO: 2364 - RNA, 19 nt, Artificial Sequence
  Synthetic oligonucleotide
ugauggagguauuuaaguu

SEQ ID NO: 2365 - RNA, 19 nt, Artificial Sequence
  Synthetic oligonucleotide
gauggagguauuuaaguuu

SEQ ID NO: 2366 - RNA, 19 nt, Artificial Sequence
  Synthetic oligonucleotide
auggagguauuuaaguuug

SEQ ID NO: 2367 - RNA, 19 nt, Artificial Sequence
  Synthetic oligonucleotide
uggagguauuuaaguuuga

SEQ ID NO: 2368 - RNA, 19 nt, Artificial Sequence
  Synthetic oligonucleotide
ggagguauuuaaguuugac

SEQ ID NO: 2369 - RNA, 19 nt, Artificial Sequence
  Synthetic oligonucleotide
gagguauuuaaguuugaca

SEQ ID NO: 2370 - RNA, 19 nt, Artificial Sequence
  Synthetic oligonucleotide
agguauuuaaguuugacac

SEQ ID NO: 2371 - RNA, 19 nt, Artificial Sequence
  Synthetic oligonucleotide
gguauuuaaguuugacacc

SEQ ID NO: 2372 - RNA, 19 nt, Artificial Sequence
  Synthetic oligonucleotide
guauuuaaguuugacacca

SEQ ID NO: 2373 - RNA, 19 nt, Artificial Sequence
  Synthetic oligonucleotide
uauuuaaguuugacaccau

SEQ ID NO: 2374 - RNA, 19 nt, Artificial Sequence
  Synthetic oligonucleotide
auuuaaguuugacaccaua

SEQ ID NO: 2375 - RNA, 19 nt, Artificial Sequence
  Synthetic oligonucleotide
uuuaaguuugacaccauau

SEQ ID NO: 2376 - RNA, 19 nt, Artificial Sequence
  Synthetic oligonucleotide
uuaaguuugacaccauauc

SEQ ID NO: 2377 - RNA, 19 nt, Artificial Sequence
  Synthetic oligonucleotide
uaaguuugacaccauaucu

SEQ ID NO: 2378 - RNA, 19 nt, Artificial Sequence
  Synthetic oligonucleotide
aaguuugacaccauaucug

SEQ ID NO: 2379 - RNA, 19 nt, Artificial Sequence
  Synthetic oligonucleotide
aguuugacaccauaucuga

SEQ ID NO: 2380 - RNA, 19 nt, Artificial Sequence
  Synthetic oligonucleotide
guuugacaccauaucugag

SEQ ID NO: 2381 - RNA, 19 nt, Artificial Sequence
  Synthetic oligonucleotide
uuugacaccauaucugaga

SEQ ID NO: 2382 - RNA, 19 nt, Artificial Sequence
  Synthetic oligonucleotide
uugacaccauaucugagaa

SEQ ID NO: 2383 - RNA, 19 nt, Artificial Sequence
  Synthetic oligonucleotide
ugacaccauaucugagaaa

SEQ ID NO: 2384 - RNA, 19 nt, Artificial Sequence
  Synthetic oligonucleotide
gacaccauaucugagaaaa

SEQ ID NO: 2385 - RNA, 19 nt, Artificial Sequence
  Synthetic oligonucleotide
acaccauaucugagaaaac

SEQ ID NO: 2386 - RNA, 19 nt, Artificial Sequence
  Synthetic oligonucleotide
caccauaucugagaaaaca

SEQ ID NO: 2387 - RNA, 19 nt, Artificial Sequence
  Synthetic oligonucleotide
accauaucugagaaaacau

SEQ ID NO: 2388 - RNA, 19 nt, Artificial Sequence
  Synthetic oligonucleotide
ccauaucugagaaaacauc

SEQ ID NO: 2389 - RNA, 19 nt, Artificial Sequence
  Synthetic oligonucleotide
cauaucugagaaaacaucu

SEQ ID NO: 2390 - RNA, 19 nt, Artificial Sequence
  Synthetic oligonucleotide
auaucugagaaaacaucug

SEQ ID NO: 2391 - RNA, 19 nt, Artificial Sequence
  Synthetic oligonucleotide
uaucugagaaaacaucuga

SEQ ID NO: 2392 - RNA, 19 nt, Artificial Sequence
  Synthetic oligonucleotide
cugagaaaacaucugauca

SEQ ID NO: 2393 - RNA, 19 nt, Artificial Sequence
  Synthetic oligonucleotide
ugagaaaacaucugaucag

SEQ ID NO: 2394 - RNA, 19 nt, Artificial Sequence
  Synthetic oligonucleotide
gagaaaacaucugaucaga

SEQ ID NO: 2395 - RNA, 19 nt, Artificial Sequence
  Synthetic oligonucleotide
agaaaacaucugaucagau

SEQ ID NO: 2396 - RNA, 19 nt, Artificial Sequence
  Synthetic oligonucleotide
aucagauccacuucuucuu

SEQ ID NO: 2397 - RNA, 19 nt, Artificial Sequence
  Synthetic oligonucleotide
cagauccacuucuucuuug

SEQ ID NO: 2398 - RNA, 19 nt, Artificial Sequence
  Synthetic oligonucleotide
agauccacuucuucuuugc

SEQ ID NO: 2399 - RNA, 19 nt, Artificial Sequence
  Synthetic oligonucleotide
gauccacuucuucuuugcc

SEQ ID NO: 2400 - RNA, 19 nt, Artificial Sequence
  Synthetic oligonucleotide
auccacuucuucuuugcca

SEQ ID NO: 2401 - RNA, 19 nt, Artificial Sequence
  Synthetic oligonucleotide
uccacuucuucuuugccaa

SEQ ID NO: 2402 - RNA, 19 nt, Artificial Sequence
  Synthetic oligonucleotide
ccacuucuucuuugccaaa

SEQ ID NO: 2403 - RNA, 19 nt, Artificial Sequence
  Synthetic oligonucleotide
cacuucuucuuugccaaac

SEQ ID NO: 2404 - RNA, 19 nt, Artificial Sequence
  Synthetic oligonucleotide
acuucuucuuugccaaacu

SEQ ID NO: 2405 - RNA, 19 nt, Artificial Sequence
  Synthetic oligonucleotide
cuucuucuuugccaaacug

SEQ ID NO: 2406 - RNA, 19 nt, Artificial Sequence
  Synthetic oligonucleotide
uucuucuuugccaaacuga

SEQ ID NO: 2407 - RNA, 19 nt, Artificial Sequence
  Synthetic oligonucleotide
ucuucuuugccaaacugaa

SEQ ID NO: 2408 - RNA, 19 nt, Artificial Sequence
  Synthetic oligonucleotide
cuucuuugccaaacugaac

SEQ ID NO: 2409 - RNA, 19 nt, Artificial Sequence
  Synthetic oligonucleotide
uucuuugccaaacugaacu

SEQ ID NO: 2410 - RNA, 19 nt, Artificial Sequence
  Synthetic oligonucleotide
ucuuugccaaacugaacug

SEQ ID NO: 2411 - RNA, 19 nt, Artificial Sequence
  Synthetic oligonucleotide
cuuugccaaacugaacugc

SEQ ID NO: 2412 - RNA, 19 nt, Artificial Sequence
  Synthetic oligonucleotide
uuugccaaacugaacugcc

SEQ ID NO: 2413 - RNA, 19 nt, Artificial Sequence
  Synthetic oligonucleotide
uugccaaacugaacugccg

SEQ ID NO: 2414 - RNA, 19 nt, Artificial Sequence
  Synthetic oligonucleotide
ugccaaacugaacugccga

SEQ ID NO: 2415 - RNA, 19 nt, Artificial Sequence
  Synthetic oligonucleotide
gccaaacugaacugccgac

SEQ ID NO: 2416 - RNA, 19 nt, Artificial Sequence
  Synthetic oligonucleotide
ccaaacugaacugccgacu

SEQ ID NO: 2417 - RNA, 19 nt, Artificial Sequence
  Synthetic oligonucleotide
caaacugaacugccgacuc

SEQ ID NO: 2418 - RNA, 19 nt, Artificial Sequence
  Synthetic oligonucleotide
aaacugaacugccgacucu

SEQ ID NO: 2419 - RNA, 19 nt, Artificial Sequence
  Synthetic oligonucleotide
aacugaacugccgacucua

SEQ ID NO: 2420 - RNA, 19 nt, Artificial Sequence
  Synthetic oligonucleotide
acugaacugccgacucuau

SEQ ID NO: 2421 - RNA, 19 nt, Artificial Sequence
  Synthetic oligonucleotide
cugaacugccgacucuauc

SEQ ID NO: 2422 - RNA, 19 nt, Artificial Sequence
  Synthetic oligonucleotide
ugaacugccgacucuaucg

SEQ ID NO: 2423 - RNA, 19 nt, Artificial Sequence
  Synthetic oligonucleotide
gaacugccgacucuaucga

SEQ ID NO: 2424 - RNA, 19 nt, Artificial Sequence
  Synthetic oligonucleotide
aacugccgacucuaucgaa

SEQ ID NO: 2425 - RNA, 19 nt, Artificial Sequence
  Synthetic oligonucleotide
acugccgacucuaucgaaa

SEQ ID NO: 2426 - RNA, 19 nt, Artificial Sequence
  Synthetic oligonucleotide
cugccgacucuaucgaaaa

SEQ ID NO: 2427 - RNA, 19 nt, Artificial Sequence
  Synthetic oligonucleotide
ugccgacucuaucgaaaag

SEQ ID NO: 2428 - RNA, 19 nt, Artificial Sequence
  Synthetic oligonucleotide
gccgacucuaucgaaaagc

SEQ ID NO: 2429 - RNA, 19 nt, Artificial Sequence
  Synthetic oligonucleotide
ccgacucuaucgaaaagcc

SEQ ID NO: 2430 - RNA, 19 nt, Artificial Sequence
  Synthetic oligonucleotide
cgacucuaucgaaaagcca

SEQ ID NO: 2431 - RNA, 19 nt, Artificial Sequence
  Synthetic oligonucleotide
gacucuaucgaaaagccaa

SEQ ID NO: 2432 - RNA, 19 nt, Artificial Sequence
  Synthetic oligonucleotide
acucuaucgaaaagccaac

SEQ ID NO: 2433 - RNA, 19 nt, Artificial Sequence
  Synthetic oligonucleotide
cucuaucgaaaagccaaca

SEQ ID NO: 2434 - RNA, 19 nt, Artificial Sequence
  Synthetic oligonucleotide
ucuaucgaaaagccaacaa

SEQ ID NO: 2435 - RNA, 19 nt, Artificial Sequence
  Synthetic oligonucleotide
aaaagccaacaaauccucc

SEQ ID NO: 2436 - RNA, 19 nt, Artificial Sequence
  Synthetic oligonucleotide
aaagccaacaaauccucca

SEQ ID NO: 2437 - RNA, 19 nt, Artificial Sequence
  Synthetic oligonucleotide
gccaacaaauccuccaagu

SEQ ID NO: 2438 - RNA, 19 nt, Artificial Sequence
  Synthetic oligonucleotide
ccaacaaauccuccaaguu

SEQ ID NO: 2439 - RNA, 19 nt, Artificial Sequence
  Synthetic oligonucleotide
caacaaauccuccaaguua

SEQ ID NO: 2440 - RNA, 19 nt, Artificial Sequence
  Synthetic oligonucleotide
aacaaauccuccaaguuag

SEQ ID NO: 2441 - RNA, 19 nt, Artificial Sequence
  Synthetic oligonucleotide
acaaauccuccaaguuagu

SEQ ID NO: 2442 - RNA, 19 nt, Artificial Sequence
  Synthetic oligonucleotide
caaauccuccaaguuagua

SEQ ID NO: 2443 - RNA, 19 nt, Artificial Sequence
  Synthetic oligonucleotide
aguuaguaucagccaaucg

SEQ ID NO: 2444 - RNA, 19 nt, Artificial Sequence
  Synthetic oligonucleotide
aguaucagccaaucgccuu

SEQ ID NO: 2445 - RNA, 19 nt, Artificial Sequence
  Synthetic oligonucleotide
cagccaaucgccuuuuugg

SEQ ID NO: 2446 - RNA, 19 nt, Artificial Sequence
  Synthetic oligonucleotide
agccaaucgccuuuuugga

SEQ ID NO: 2447 - RNA, 19 nt, Artificial Sequence
  Synthetic oligonucleotide
gccaaucgccuuuuuggag

SEQ ID NO: 2448 - RNA, 19 nt, Artificial Sequence
  Synthetic oligonucleotide
aucgccuuuuuggagacaa

SEQ ID NO: 2449 - RNA, 19 nt, Artificial Sequence
  Synthetic oligonucleotide
cgccuuuuuggagacaaau

SEQ ID NO: 2450 - RNA, 19 nt, Artificial Sequence
  Synthetic oligonucleotide
gccuuuuuggagacaaauc

SEQ ID NO: 2451 - RNA, 19 nt, Artificial Sequence
  Synthetic oligonucleotide
ccuuuuuggagacaaaucc

SEQ ID NO: 2452 - RNA, 19 nt, Artificial Sequence
  Synthetic oligonucleotide
cuuuuuggagacaaauccc

SEQ ID NO: 2453 - RNA, 19 nt, Artificial Sequence
  Synthetic oligonucleotide
uuuuuggagacaaaucccu

SEQ ID NO: 2454 - RNA, 19 nt, Artificial Sequence
  Synthetic oligonucleotide
uggagacaaaucccuuacc

SEQ ID NO: 2455 - RNA, 19 nt, Artificial Sequence
  Synthetic oligonucleotide
ggagacaaaucccuuaccu

SEQ ID NO: 2456 - RNA, 19 nt, Artificial Sequence
  Synthetic oligonucleotide
gagacaaaucccuuaccuu

SEQ ID NO: 2457 - RNA, 19 nt, Artificial Sequence
  Synthetic oligonucleotide
agacaaaucccuuaccuuc

SEQ ID NO: 2458 - RNA, 19 nt, Artificial Sequence
  Synthetic oligonucleotide
gacaaaucccuuaccuuca

SEQ ID NO: 2459 - RNA, 19 nt, Artificial Sequence
  Synthetic oligonucleotide
acaaaucccuuaccuucaa

SEQ ID NO: 2460 - RNA, 19 nt, Artificial Sequence
  Synthetic oligonucleotide
aaaucccuuaccuucaaug

SEQ ID NO: 2461 - RNA, 19 nt, Artificial Sequence
  Synthetic oligonucleotide
aaucccuuaccuucaauga

SEQ ID NO: 2462 - RNA, 19 nt, Artificial Sequence
  Synthetic oligonucleotide
aucccuuaccuucaaugag

SEQ ID NO: 2463 - RNA, 19 nt, Artificial Sequence
  Synthetic oligonucleotide
accuucaaugagaccuacc

SEQ ID NO: 2464 - RNA, 19 nt, Artificial Sequence
  Synthetic oligonucleotide
ucaaugagaccuaccagga

SEQ ID NO: 2465 - RNA, 19 nt, Artificial Sequence
  Synthetic oligonucleotide
caaugagaccuaccaggac

SEQ ID NO: 2466 - RNA, 19 nt, Artificial Sequence
  Synthetic oligonucleotide
aaugagaccuaccaggaca

SEQ ID NO: 2467 - RNA, 19 nt, Artificial Sequence
  Synthetic oligonucleotide
ugagaccuaccaggacauc

SEQ ID NO: 2468 - RNA, 19 nt, Artificial Sequence
  Synthetic oligonucleotide
agaccuaccaggacaucag

SEQ ID NO: 2469 - RNA, 19 nt, Artificial Sequence
  Synthetic oligonucleotide
cuaccaggacaucagugag

SEQ ID NO: 2470 - RNA, 19 nt, Artificial Sequence
  Synthetic oligonucleotide
uaccaggacaucagugagu

SEQ ID NO: 2471 - RNA, 19 nt, Artificial Sequence
  Synthetic oligonucleotide
accaggacaucagugaguu

SEQ ID NO: 2472 - RNA, 19 nt, Artificial Sequence
  Synthetic oligonucleotide
ccaggacaucagugaguug

SEQ ID NO: 2473 - RNA, 19 nt, Artificial Sequence
  Synthetic oligonucleotide
caggacaucagugaguugg

SEQ ID NO: 2474 - RNA, 19 nt, Artificial Sequence
  Synthetic oligonucleotide
aggacaucagugaguuggu

SEQ ID NO: 2475 - RNA, 19 nt, Artificial Sequence
  Synthetic oligonucleotide
ggacaucagugaguuggua

SEQ ID NO: 2476 - RNA, 19 nt, Artificial Sequence
  Synthetic oligonucleotide
gacaucagugaguugguau

SEQ ID NO: 2477 - RNA, 19 nt, Artificial Sequence
  Synthetic oligonucleotide
acaucagugaguugguaua

SEQ ID NO: 2478 - RNA, 19 nt, Artificial Sequence
  Synthetic oligonucleotide
uauggagccaagcuccagc

SEQ ID NO: 2479 - RNA, 19 nt, Artificial Sequence
  Synthetic oligonucleotide
auggagccaagcuccagcc

SEQ ID NO: 2480 - RNA, 19 nt, Artificial Sequence
  Synthetic oligonucleotide
uggagccaagcuccagccc

SEQ ID NO: 2481 - RNA, 19 nt, Artificial Sequence
  Synthetic oligonucleotide
ggagccaagcuccagcccc

SEQ ID NO: 2482 - RNA, 19 nt, Artificial Sequence
  Synthetic oligonucleotide
gagccaagcuccagccccu

SEQ ID NO: 2483 - RNA, 19 nt, Artificial Sequence
  Synthetic oligonucleotide
agccaagcuccagccccug

SEQ ID NO: 2484 - RNA, 19 nt, Artificial Sequence
  Synthetic oligonucleotide
gccaagcuccagccccugg

SEQ ID NO: 2485 - RNA, 19 nt, Artificial Sequence
  Synthetic oligonucleotide
ccaagcuccagccccugga

SEQ ID NO: 2486 - RNA, 19 nt, Artificial Sequence
  Synthetic oligonucleotide
caagcuccagccccuggac

SEQ ID NO: 2487 - RNA, 19 nt, Artificial Sequence
  Synthetic oligonucleotide
aagcuccagccccuggacu

SEQ ID NO: 2488 - RNA, 19 nt, Artificial Sequence
  Synthetic oligonucleotide
agcuccagccccuggacuu

SEQ ID NO: 2489 - RNA, 19 nt, Artificial Sequence
  Synthetic oligonucleotide
gcuccagccccuggacuuc

SEQ ID NO: 2490 - RNA, 19 nt, Artificial Sequence
  Synthetic oligonucleotide
cuccagccccuggacuuca

SEQ ID NO: 2491 - RNA, 19 nt, Artificial Sequence
  Synthetic oligonucleotide
uccagccccuggacuucaa

SEQ ID NO: 2492 - RNA, 19 nt, Artificial Sequence
  Synthetic oligonucleotide
ccagccccuggacuucaag

SEQ ID NO: 2493 - RNA, 19 nt, Artificial Sequence
  Synthetic oligonucleotide
cagccccuggacuucaagg

SEQ ID NO: 2494 - RNA, 19 nt, Artificial Sequence
  Synthetic oligonucleotide
agccccuggacuucaagga

SEQ ID NO: 2495 - RNA, 19 nt, Artificial Sequence
  Synthetic oligonucleotide
gccccuggacuucaaggaa

SEQ ID NO: 2496 - RNA, 19 nt, Artificial Sequence
  Synthetic oligonucleotide
uggacuucaaggaaaaugc

SEQ ID NO: 2497 - RNA, 19 nt, Artificial Sequence
  Synthetic oligonucleotide
ggacuucaaggaaaaugca

SEQ ID NO: 2498 - RNA, 19 nt, Artificial Sequence
  Synthetic oligonucleotide
gacuucaaggaaaaugcag

SEQ ID NO: 2499 - RNA, 19 nt, Artificial Sequence
  Synthetic oligonucleotide
acuucaaggaaaaugcaga

SEQ ID NO: 2500 - RNA, 19 nt, Artificial Sequence
  Synthetic oligonucleotide
uucaaggaaaaugcagagc

SEQ ID NO: 2501 - RNA, 19 nt, Artificial Sequence
  Synthetic oligonucleotide
ucaaggaaaaugcagagca

SEQ ID NO: 2502 - RNA, 19 nt, Artificial Sequence
  Synthetic oligonucleotide
caaggaaaaugcagagcaa

SEQ ID NO: 2503 - RNA, 19 nt, Artificial Sequence
  Synthetic oligonucleotide
aaggaaaaugcagagcaau

SEQ ID NO: 2504 - RNA, 19 nt, Artificial Sequence
  Synthetic oligonucleotide
caucaacaaaugggugucc

SEQ ID NO: 2505 - RNA, 19 nt, Artificial Sequence
  Synthetic oligonucleotide
aucaacaaaugggugucca

SEQ ID NO: 2506 - RNA, 19 nt, Artificial Sequence
  Synthetic oligonucleotide
caaauggguguccaauaag

SEQ ID NO: 2507 - RNA, 19 nt, Artificial Sequence
  Synthetic oligonucleotide
gagcucacuguucuggugc

SEQ ID NO: 2508 - RNA, 19 nt, Artificial Sequence
  Synthetic oligonucleotide
gcucacuguucuggugcug

SEQ ID NO: 2509 - RNA, 19 nt, Artificial Sequence
  Synthetic oligonucleotide
cucacuguucuggugcugg

SEQ ID NO: 2510 - RNA, 19 nt, Artificial Sequence
  Synthetic oligonucleotide
ucacuguucuggugcuggu

SEQ ID NO: 2511 - RNA, 19 nt, Artificial Sequence
  Synthetic oligonucleotide
cacuguucuggugcugguu

SEQ ID NO: 2512 - RNA, 19 nt, Artificial Sequence
  Synthetic oligonucleotide
acuguucuggugcugguua

SEQ ID NO: 2513 - RNA, 19 nt, Artificial Sequence
  Synthetic oligonucleotide
cuguucuggugcugguuaa

SEQ ID NO: 2514 - RNA, 19 nt, Artificial Sequence
  Synthetic oligonucleotide
uguucuggugcugguuaac

SEQ ID NO: 2515 - RNA, 19 nt, Artificial Sequence
  Synthetic oligonucleotide
guucuggugcugguuaaca

SEQ ID NO: 2516 - RNA, 19 nt, Artificial Sequence
  Synthetic oligonucleotide
uucuggugcugguuaacac

SEQ ID NO: 2517 - RNA, 19 nt, Artificial Sequence
  Synthetic oligonucleotide
ucuggugcugguuaacacc

SEQ ID NO: 2518 - RNA, 19 nt, Artificial Sequence
  Synthetic oligonucleotide
cuggugcugguuaacacca

SEQ ID NO: 2519 - RNA, 19 nt, Artificial Sequence
  Synthetic oligonucleotide
uggugcugguuaacaccau

SEQ ID NO: 2520 - RNA, 19 nt, Artificial Sequence
  Synthetic oligonucleotide
ggugcugguuaacaccauu

SEQ ID NO: 2521 - RNA, 19 nt, Artificial Sequence
  Synthetic oligonucleotide
gugcugguuaacaccauuu

SEQ ID NO: 2522 - RNA, 19 nt, Artificial Sequence
  Synthetic oligonucleotide
ugcugguuaacaccauuua

SEQ ID NO: 2523 - RNA, 19 nt, Artificial Sequence
  Synthetic oligonucleotide
gcugguuaacaccauuuac

SEQ ID NO: 2524 - RNA, 19 nt, Artificial Sequence
  Synthetic oligonucleotide
cugguuaacaccauuuacu

SEQ ID NO: 2525 - RNA, 19 nt, Artificial Sequence
  Synthetic oligonucleotide
ugguuaacaccauuuacuu

SEQ ID NO: 2526 - RNA, 19 nt, Artificial Sequence
  Synthetic oligonucleotide
gguuaacaccauuuacuuc

SEQ ID NO: 2527 - RNA, 19 nt, Artificial Sequence
  Synthetic oligonucleotide
guuaacaccauuuacuuca

SEQ ID NO: 2528 - RNA, 19 nt, Artificial Sequence
  Synthetic oligonucleotide
uuaacaccauuuacuucaa

SEQ ID NO: 2529 - RNA, 19 nt, Artificial Sequence
  Synthetic oligonucleotide
uaacaccauuuacuucaag

SEQ ID NO: 2530 - RNA, 19 nt, Artificial Sequence
  Synthetic oligonucleotide
aacaccauuuacuucaagg

SEQ ID NO: 2531 - RNA, 19 nt, Artificial Sequence
  Synthetic oligonucleotide
acaccauuuacuucaaggg

SEQ ID NO: 2532 - RNA, 19 nt, Artificial Sequence
  Synthetic oligonucleotide
caccauuuacuucaagggc

SEQ ID NO: 2533 - RNA, 19 nt, Artificial Sequence
  Synthetic oligonucleotide
accauuuacuucaagggcc

SEQ ID NO: 2534 - RNA, 19 nt, Artificial Sequence
  Synthetic oligonucleotide
ccauuuacuucaagggccu

SEQ ID NO: 2535 - RNA, 19 nt, Artificial Sequence
  Synthetic oligonucleotide
cauuuacuucaagggccug

SEQ ID NO: 2536 - RNA, 19 nt, Artificial Sequence
  Synthetic oligonucleotide
auuuacuucaagggccugu

SEQ ID NO: 2537 - RNA, 19 nt, Artificial Sequence
  Synthetic oligonucleotide
uuuacuucaagggccugug

SEQ ID NO: 2538 - RNA, 19 nt, Artificial Sequence
  Synthetic oligonucleotide
uuacuucaagggccugugg

SEQ ID NO: 2539 - RNA, 19 nt, Artificial Sequence
  Synthetic oligonucleotide
uacuucaagggccugugga

SEQ ID NO: 2540 - RNA, 19 nt, Artificial Sequence
  Synthetic oligonucleotide
acuucaagggccuguggaa

SEQ ID NO: 2541 - RNA, 19 nt, Artificial Sequence
  Synthetic oligonucleotide
cuucaagggccuguggaag

SEQ ID NO: 2542 - RNA, 19 nt, Artificial Sequence
  Synthetic oligonucleotide
uucaagggccuguggaagu

SEQ ID NO: 2543 - RNA, 19 nt, Artificial Sequence
  Synthetic oligonucleotide
ucaagggccuguggaaguc

SEQ ID NO: 2544 - RNA, 19 nt, Artificial Sequence
  Synthetic oligonucleotide
caagggccuguggaaguca

SEQ ID NO: 2545 - RNA, 19 nt, Artificial Sequence
  Synthetic oligonucleotide
aagggccuguggaagucaa

SEQ ID NO: 2546 - RNA, 19 nt, Artificial Sequence
  Synthetic oligonucleotide
agggccuguggaagucaaa

SEQ ID NO: 2547 - RNA, 19 nt, Artificial Sequence
  Synthetic oligonucleotide
gggccuguggaagucaaag

SEQ ID NO: 2548 - RNA, 19 nt, Artificial Sequence
  Synthetic oligonucleotide
ggccuguggaagucaaagu

SEQ ID NO: 2549 - RNA, 19 nt, Artificial Sequence
  Synthetic oligonucleotide
gccuguggaagucaaaguu

SEQ ID NO: 2550 - RNA, 19 nt, Artificial Sequence
  Synthetic oligonucleotide
ccuguggaagucaaaguuc

SEQ ID NO: 2551 - RNA, 19 nt, Artificial Sequence
  Synthetic oligonucleotide
cuguggaagucaaaguuca

SEQ ID NO: 2552 - RNA, 19 nt, Artificial Sequence
  Synthetic oligonucleotide
uguggaagucaaaguucag

SEQ ID NO: 2553 - RNA, 19 nt, Artificial Sequence
  Synthetic oligonucleotide
guggaagucaaaguucagc

SEQ ID NO: 2554 - RNA, 19 nt, Artificial Sequence
  Synthetic oligonucleotide
uggaagucaaaguucagcc

SEQ ID NO: 2555 - RNA, 19 nt, Artificial Sequence
  Synthetic oligonucleotide
ggaagucaaaguucagccc

SEQ ID NO: 2556 - RNA, 19 nt, Artificial Sequence
  Synthetic oligonucleotide
gaagucaaaguucagcccu

SEQ ID NO: 2557 - RNA, 19 nt, Artificial Sequence
  Synthetic oligonucleotide
aagucaaaguucagcccug

SEQ ID NO: 2558 - RNA, 19 nt, Artificial Sequence
  Synthetic oligonucleotide
agucaaaguucagcccuga

SEQ ID NO: 2559 - RNA, 19 nt, Artificial Sequence
  Synthetic oligonucleotide
caaggcugauggagagucg

SEQ ID NO: 2560 - RNA, 19 nt, Artificial Sequence
  Synthetic oligonucleotide
gauggagagucguguucag

SEQ ID NO: 2561 - RNA, 19 nt, Artificial Sequence
  Synthetic oligonucleotide
auggagagucguguucagc

SEQ ID NO: 2562 - RNA, 19 nt, Artificial Sequence
  Synthetic oligonucleotide
cuaugauguaccaggaagg

SEQ ID NO: 2563 - RNA, 19 nt, Artificial Sequence
  Synthetic oligonucleotide
uaugauguaccaggaaggc

SEQ ID NO: 2564 - RNA, 19 nt, Artificial Sequence
  Synthetic oligonucleotide
augauguaccaggaaggca

SEQ ID NO: 2565 - RNA, 19 nt, Artificial Sequence
  Synthetic oligonucleotide
ugauguaccaggaaggcaa

SEQ ID NO: 2566 - RNA, 19 nt, Artificial Sequence
  Synthetic oligonucleotide
auguaccaggaaggcaagu

SEQ ID NO: 2567 - RNA, 19 nt, Artificial Sequence
  Synthetic oligonucleotide
ccaggugcuugaguugccc

SEQ ID NO: 2568 - RNA, 19 nt, Artificial Sequence
  Synthetic oligonucleotide
ggugcuugaguugcccuuc

SEQ ID NO: 2569 - RNA, 19 nt, Artificial Sequence
  Synthetic oligonucleotide
gugcuugaguugcccuuca

SEQ ID NO: 2570 - RNA, 19 nt, Artificial Sequence
  Synthetic oligonucleotide
ugcuugaguugcccuucaa

SEQ ID NO: 2571 - RNA, 19 nt, Artificial Sequence
  Synthetic oligonucleotide
ggugaugacaucaccaugg

SEQ ID NO: 2572 - RNA, 19 nt, Artificial Sequence
  Synthetic oligonucleotide
gugaugacaucaccauggu

SEQ ID NO: 2573 - RNA, 19 nt, Artificial Sequence
  Synthetic oligonucleotide
ugcccaagccugagaagag

SEQ ID NO: 2574 - RNA, 19 nt, Artificial Sequence
  Synthetic oligonucleotide
gcccaagccugagaagagc

SEQ ID NO: 2575 - RNA, 19 nt, Artificial Sequence
  Synthetic oligonucleotide
cccaagccugagaagagcc

SEQ ID NO: 2576 - RNA, 19 nt, Artificial Sequence
  Synthetic oligonucleotide
ccaagccugagaagagccu

SEQ ID NO: 2577 - RNA, 19 nt, Artificial Sequence
  Synthetic oligonucleotide
caagccugagaagagccug

SEQ ID NO: 2578 - RNA, 19 nt, Artificial Sequence
  Synthetic oligonucleotide
aagccugagaagagccugg

SEQ ID NO: 2579 - RNA, 19 nt, Artificial Sequence
  Synthetic oligonucleotide
agccugagaagagccuggc

SEQ ID NO: 2580 - RNA, 19 nt, Artificial Sequence
  Synthetic oligonucleotide
gccugagaagagccuggcc

SEQ ID NO: 2581 - RNA, 19 nt, Artificial Sequence
  Synthetic oligonucleotide
ccugagaagagccuggcca

SEQ ID NO: 2582 - RNA, 19 nt, Artificial Sequence
  Synthetic oligonucleotide
cugagaagagccuggccaa

SEQ ID NO: 2583 - RNA, 19 nt, Artificial Sequence
  Synthetic oligonucleotide
ugagaagagccuggccaag

SEQ ID NO: 2584 - RNA, 19 nt, Artificial Sequence
  Synthetic oligonucleotide
gagaagagccuggccaagg

SEQ ID NO: 2585 - RNA, 19 nt, Artificial Sequence
  Synthetic oligonucleotide
agaagagccuggccaaggu

SEQ ID NO: 2586 - RNA, 19 nt, Artificial Sequence
  Synthetic oligonucleotide
gugguccacaugccccgcu

SEQ ID NO: 2587 - RNA, 19 nt, Artificial Sequence
  Synthetic oligonucleotide
ugguccacaugccccgcuu

SEQ ID NO: 2588 - RNA, 19 nt, Artificial Sequence
  Synthetic oligonucleotide
gguccacaugccccgcuuc

SEQ ID NO: 2589 - RNA, 19 nt, Artificial Sequence
  Synthetic oligonucleotide
guccacaugccccgcuucc

SEQ ID NO: 2590 - RNA, 19 nt, Artificial Sequence
  Synthetic oligonucleotide
uccacaugccccgcuuccg

SEQ ID NO: 2591 - RNA, 19 nt, Artificial Sequence
  Synthetic oligonucleotide
ccacaugccccgcuuccgc

SEQ ID NO: 2592 - RNA, 19 nt, Artificial Sequence
  Synthetic oligonucleotide
cacaugccccgcuuccgca

SEQ ID NO: 2593 - RNA, 19 nt, Artificial Sequence
  Synthetic oligonucleotide
aguuugaaggagcagcugc

SEQ ID NO: 2594 - RNA, 19 nt, Artificial Sequence
  Synthetic oligonucleotide
guuugaaggagcagcugca

SEQ ID NO: 2595 - RNA, 19 nt, Artificial Sequence
  Synthetic oligonucleotide
ugaaggagcagcugcaaga

SEQ ID NO: 2596 - RNA, 19 nt, Artificial Sequence
  Synthetic oligonucleotide
gaaggagcagcugcaagac

SEQ ID NO: 2597 - RNA, 19 nt, Artificial Sequence
  Synthetic oligonucleotide
aaggagcagcugcaagaca

SEQ ID NO: 2598 - RNA, 19 nt, Artificial Sequence
  Synthetic oligonucleotide
aggagcagcugcaagacau

SEQ ID NO: 2599 - RNA, 19 nt, Artificial Sequence
  Synthetic oligonucleotide
ggagcagcugcaagacaug

SEQ ID NO: 2600 - RNA, 19 nt, Artificial Sequence
  Synthetic oligonucleotide
gagcagcugcaagacaugg

SEQ ID NO: 2601 - RNA, 19 nt, Artificial Sequence
  Synthetic oligonucleotide
agcagcugcaagacauggg

SEQ ID NO: 2602 - RNA, 19 nt, Artificial Sequence
  Synthetic oligonucleotide
gcagcugcaagacaugggc

SEQ ID NO: 2603 - RNA, 19 nt, Artificial Sequence
  Synthetic oligonucleotide
cagcugcaagacaugggcc

SEQ ID NO: 2604 - RNA, 19 nt, Artificial Sequence
  Synthetic oligonucleotide
agcugcaagacaugggccu

SEQ ID NO: 2605 - RNA, 19 nt, Artificial Sequence
  Synthetic oligonucleotide
uugucgaucuguucagccc

SEQ ID NO: 2606 - RNA, 19 nt, Artificial Sequence
  Synthetic oligonucleotide
gucgaucuguucagcccug

SEQ ID NO: 2607 - RNA, 19 nt, Artificial Sequence
  Synthetic oligonucleotide
ucgaucuguucagcccuga

SEQ ID NO: 2608 - RNA, 19 nt, Artificial Sequence
  Synthetic oligonucleotide
gaucuguucagcccugaaa

SEQ ID NO: 2609 - RNA, 19 nt, Artificial Sequence
  Synthetic oligonucleotide
cuguucagcccugaaaagu

SEQ ID NO: 2610 - RNA, 19 nt, Artificial Sequence
  Synthetic oligonucleotide
guucagcccugaaaagucc

SEQ ID NO: 2611 - RNA, 19 nt, Artificial Sequence
  Synthetic oligonucleotide
aaaguccaaacucccaggu

SEQ ID NO: 2612 - RNA, 19 nt, Artificial Sequence
  Synthetic oligonucleotide
aaguccaaacucccaggua

SEQ ID NO: 2613 - RNA, 19 nt, Artificial Sequence
  Synthetic oligonucleotide
guccaaacucccagguauu

SEQ ID NO: 2614 - RNA, 19 nt, Artificial Sequence
  Synthetic oligonucleotide
ccaaacucccagguauugu

SEQ ID NO: 2615 - RNA, 19 nt, Artificial Sequence
  Synthetic oligonucleotide
caaacucccagguauuguu

SEQ ID NO: 2616 - RNA, 19 nt, Artificial Sequence
  Synthetic oligonucleotide
aaacucccagguauuguug

SEQ ID NO: 2617 - RNA, 19 nt, Artificial Sequence
  Synthetic oligonucleotide
aacucccagguauuguugc

SEQ ID NO: 2618 - RNA, 19 nt, Artificial Sequence
  Synthetic oligonucleotide
cauaaggcauuucuugagg

SEQ ID NO: 2619 - RNA, 19 nt, Artificial Sequence
  Synthetic oligonucleotide
auaaggcauuucuugaggu

SEQ ID NO: 2620 - RNA, 19 nt, Artificial Sequence
  Synthetic oligonucleotide
uaaggcauuucuugaggua

SEQ ID NO: 2621 - RNA, 19 nt, Artificial Sequence
  Synthetic oligonucleotide
aaggcauuucuugagguaa

SEQ ID NO: 2622 - RNA, 19 nt, Artificial Sequence
  Synthetic oligonucleotide
aggcauuucuugagguaaa

SEQ ID NO: 2623 - RNA, 19 nt, Artificial Sequence
  Synthetic oligonucleotide
ggcauuucuugagguaaau

SEQ ID NO: 2624 - RNA, 19 nt, Artificial Sequence
  Synthetic oligonucleotide
gcauuucuugagguaaaug

SEQ ID NO: 2625 - RNA, 19 nt, Artificial Sequence
  Synthetic oligonucleotide
cauuucuugagguaaauga

SEQ ID NO: 2626 - RNA, 19 nt, Artificial Sequence
  Synthetic oligonucleotide
ugagguaaaugaagaaggc

SEQ ID NO: 2627 - RNA, 19 nt, Artificial Sequence
  Synthetic oligonucleotide
gagguaaaugaagaaggca

SEQ ID NO: 2628 - RNA, 19 nt, Artificial Sequence
  Synthetic oligonucleotide
agguaaaugaagaaggcag

SEQ ID NO: 2629 - RNA, 19 nt, Artificial Sequence
  Synthetic oligonucleotide
gguaaaugaagaaggcagu

SEQ ID NO: 2630 - RNA, 19 nt, Artificial Sequence
  Synthetic oligonucleotide
guaaaugaagaaggcagug

SEQ ID NO: 2631 - RNA, 19 nt, Artificial Sequence
  Synthetic oligonucleotide
uaaaugaagaaggcaguga

SEQ ID NO: 2632 - RNA, 19 nt, Artificial Sequence
  Synthetic oligonucleotide
aaaugaagaaggcagugaa

SEQ ID NO: 2633 - RNA, 19 nt, Artificial Sequence
  Synthetic oligonucleotide
aagaaggcagugaagcagc

SEQ ID NO: 2634 - RNA, 19 nt, Artificial Sequence
  Synthetic oligonucleotide
aaggcagugaagcagcugc

SEQ ID NO: 2635 - RNA, 19 nt, Artificial Sequence
  Synthetic oligonucleotide
aggcagugaagcagcugca

SEQ ID NO: 2636 - RNA, 19 nt, Artificial Sequence
  Synthetic oligonucleotide
aagcagcugcaaguaccgc

SEQ ID NO: 2637 - RNA, 19 nt, Artificial Sequence
  Synthetic oligonucleotide
aacaggccuuuccugguuu

SEQ ID NO: 2638 - RNA, 19 nt, Artificial Sequence
  Synthetic oligonucleotide
acaggccuuuccugguuuu

SEQ ID NO: 2639 - RNA, 19 nt, Artificial Sequence
  Synthetic oligonucleotide
caggccuuuccugguuuuu

SEQ ID NO: 2640 - RNA, 19 nt, Artificial Sequence
  Synthetic oligonucleotide
aggccuuuccugguuuuua

SEQ ID NO: 2641 - RNA, 19 nt, Artificial Sequence
  Synthetic oligonucleotide
ggccuuuccugguuuuuau

SEQ ID NO: 2642 - RNA, 19 nt, Artificial Sequence
  Synthetic oligonucleotide
gccuuuccugguuuuuaua

SEQ ID NO: 2643 - RNA, 19 nt, Artificial Sequence
  Synthetic oligonucleotide
cuuuccugguuuuuauaag

SEQ ID NO: 2644 - RNA, 19 nt, Artificial Sequence
  Synthetic oligonucleotide
uuuccugguuuuuauaaga

SEQ ID NO: 2645 - RNA, 19 nt, Artificial Sequence
  Synthetic oligonucleotide
uuccugguuuuuauaagag

SEQ ID NO: 2646 - RNA, 19 nt, Artificial Sequence
  Synthetic oligonucleotide
uccugguuuuuauaagaga

SEQ ID NO: 2647 - RNA, 19 nt, Artificial Sequence
  Synthetic oligonucleotide
ccugguuuuuauaagagaa

SEQ ID NO: 2648 - RNA, 19 nt, Artificial Sequence
  Synthetic oligonucleotide
cugguuuuuauaagagaag

SEQ ID NO: 2649 - RNA, 19 nt, Artificial Sequence
  Synthetic oligonucleotide
ugguuuuuauaagagaagu

SEQ ID NO: 2650 - RNA, 19 nt, Artificial Sequence
  Synthetic oligonucleotide
gguuuuuauaagagaaguu

SEQ ID NO: 2651 - RNA, 19 nt, Artificial Sequence
  Synthetic oligonucleotide
guuuuuauaagagaaguuc

SEQ ID NO: 2652 - RNA, 19 nt, Artificial Sequence
  Synthetic oligonucleotide
uuuuuauaagagaaguucc

SEQ ID NO: 2653 - RNA, 19 nt, Artificial Sequence
  Synthetic oligonucleotide
uuuuauaagagaaguuccu

SEQ ID NO: 2654 - RNA, 19 nt, Artificial Sequence
  Synthetic oligonucleotide
uuuauaagagaaguuccuc

SEQ ID NO: 2655 - RNA, 19 nt, Artificial Sequence
  Synthetic oligonucleotide
uuauaagagaaguuccucu

SEQ ID NO: 2656 - RNA, 19 nt, Artificial Sequence
  Synthetic oligonucleotide
uauaagagaaguuccucug

SEQ ID NO: 2657 - RNA, 19 nt, Artificial Sequence
  Synthetic oligonucleotide
auaagagaaguuccucuga

SEQ ID NO: 2658 - RNA, 19 nt, Artificial Sequence
  Synthetic oligonucleotide
uaagagaaguuccucugaa

SEQ ID NO: 2659 - RNA, 19 nt, Artificial Sequence
  Synthetic oligonucleotide
aagagaaguuccucugaac

SEQ ID NO: 2660 - RNA, 19 nt, Artificial Sequence
  Synthetic oligonucleotide
agagaaguuccucugaaca

SEQ ID NO: 2661 - RNA, 19 nt, Artificial Sequence
  Synthetic oligonucleotide
gagaaguuccucugaacac

SEQ ID NO: 2662 - RNA, 19 nt, Artificial Sequence
  Synthetic oligonucleotide
agaaguuccucugaacacu

SEQ ID NO: 2663 - RNA, 19 nt, Artificial Sequence
  Synthetic oligonucleotide
gaaguuccucugaacacua

SEQ ID NO: 2664 - RNA, 19 nt, Artificial Sequence
  Synthetic oligonucleotide
aaguuccucugaacacuau

SEQ ID NO: 2665 - RNA, 19 nt, Artificial Sequence
  Synthetic oligonucleotide
aguuccucugaacacuauu

SEQ ID NO: 2666 - RNA, 19 nt, Artificial Sequence
  Synthetic oligonucleotide
guuccucugaacacuauua

SEQ ID NO: 2667 - RNA, 19 nt, Artificial Sequence
  Synthetic oligonucleotide
uuccucugaacacuauuau

SEQ ID NO: 2668 - RNA, 19 nt, Artificial Sequence
  Synthetic oligonucleotide
uccucugaacacuauuauc

SEQ ID NO: 2669 - RNA, 19 nt, Artificial Sequence
  Synthetic oligonucleotide
ccucugaacacuauuaucu

SEQ ID NO: 2670 - RNA, 19 nt, Artificial Sequence
  Synthetic oligonucleotide
cucugaacacuauuaucuu

SEQ ID NO: 2671 - RNA, 19 nt, Artificial Sequence
  Synthetic oligonucleotide
cugaacacuauuaucuuca

SEQ ID NO: 2672 - RNA, 19 nt, Artificial Sequence
  Synthetic oligonucleotide
cacuauuaucuucaugggc

SEQ ID NO: 2673 - RNA, 19 nt, Artificial Sequence
  Synthetic oligonucleotide
agaaguaaaaauaaauaca

SEQ ID NO: 2674 - RNA, 19 nt, Artificial Sequence
  Synthetic oligonucleotide
gaaguaaaaauaaauacaa

SEQ ID NO: 2675 - RNA, 19 nt, Artificial Sequence
  Synthetic oligonucleotide
ggugagauauaagacauaa

SEQ ID NO: 2676 - RNA, 19 nt, Artificial Sequence
  Synthetic oligonucleotide
agcagcugauggagguuuu

SEQ ID NO: 2677 - RNA, 19 nt, Artificial Sequence
  Synthetic oligonucleotide
auggagguuuuuaaauuug

SEQ ID NO: 2678 - RNA, 19 nt, Artificial Sequence
  Synthetic oligonucleotide
ggaaguugcacugaacacu

SEQ ID NO: 2679 - RNA, 19 nt, Artificial Sequence
  Synthetic oligonucleotide
aguugcacugaacacuauu

SEQ ID NO: 2680 - RNA, 19 nt, Artificial Sequence
  Synthetic oligonucleotide
uugcacugaacacuauuau

SEQ ID NO: 2681 - RNA, 19 nt, Artificial Sequence
  Synthetic oligonucleotide
cuuugguguuugugaauag

SEQ ID NO: 2682 - RNA, 19 nt, Artificial Sequence
  Synthetic oligonucleotide
gguguuugugaauagaagu

SEQ ID NO: 2683 - RNA, 19 nt, Artificial Sequence
  Synthetic oligonucleotide
guguuugugaauagaagua

SEQ ID NO: 2684 - RNA, 19 nt, Artificial Sequence
  Synthetic oligonucleotide
uguuugugaauagaaguaa

SEQ ID NO: 2685 - RNA, 19 nt, Artificial Sequence
  Synthetic oligonucleotide
guuugugaauagaaguaaa

SEQ ID NO: 2686 - RNA, 19 nt, Artificial Sequence
  Synthetic oligonucleotide
gugaauagaaguaaaaaua

SEQ ID NO: 2687 - RNA, 19 nt, Artificial Sequence
  Synthetic oligonucleotide
aagagguaaauauauuacu

SEQ ID NO: 2688 - RNA, 19 nt, Artificial Sequence
  Synthetic oligonucleotide
agaaaugcauuuuuauaca

SEQ ID NO: 2689 - RNA, 19 nt, Artificial Sequence
  Synthetic oligonucleotide
gccauguauuccaauguga

SEQ ID NO: 2690 - RNA, 19 nt, Artificial Sequence
  Synthetic oligonucleotide
ccauguauuccaaugugau

SEQ ID NO: 2691 - RNA, 19 nt, Artificial Sequence
  Synthetic oligonucleotide
cauguauuccaaugugaua

SEQ ID NO: 2692 - RNA, 19 nt, Artificial Sequence
  Synthetic oligonucleotide
auguauuccaaugugauag

SEQ ID NO: 2693 - RNA, 19 nt, Artificial Sequence
  Synthetic oligonucleotide
uguauuccaaugugauagg

SEQ ID NO: 2694 - RNA, 19 nt, Artificial Sequence
  Synthetic oligonucleotide
guauuccaaugugauagga

SEQ ID NO: 2695 - RNA, 19 nt, Artificial Sequence
  Synthetic oligonucleotide
uauuccaaugugauaggaa

SEQ ID NO: 2696 - RNA, 19 nt, Artificial Sequence
  Synthetic oligonucleotide
ccucuggaaaaaggaaggu

SEQ ID NO: 2697 - RNA, 19 nt, Artificial Sequence
  Synthetic oligonucleotide
cucuggaaaaaggaagguu

SEQ ID NO: 2698 - RNA, 19 nt, Artificial Sequence
  Synthetic oligonucleotide
ucuggaaaaaggaagguuu

SEQ ID NO: 2699 - RNA, 19 nt, Artificial Sequence
  Synthetic oligonucleotide
uggaaaaaggaagguuuau

SEQ ID NO: 2700 - RNA, 19 nt, Artificial Sequence
  Synthetic oligonucleotide
ggaaaaaggaagguuuauc

SEQ ID NO: 2701 - RNA, 19 nt, Artificial Sequence
  Synthetic oligonucleotide
gaaaaaggaagguuuaucu

SEQ ID NO: 2702 - RNA, 19 nt, Artificial Sequence
  Synthetic oligonucleotide
uucccaugaaucccaugug

SEQ ID NO: 2703 - RNA, 19 nt, Artificial Sequence
  Synthetic oligonucleotide
ucccaugaaucccaugugc

SEQ ID NO: 2704 - RNA, 19 nt, Artificial Sequence
  Synthetic oligonucleotide
caugaaucccaugugcauu

SEQ ID NO: 2705 - RNA, 19 nt, Artificial Sequence
  Synthetic oligonucleotide
augugcauuuaccgcuccc

SEQ ID NO: 2706 - RNA, 19 nt, Artificial Sequence
  Synthetic oligonucleotide
ugucugggaacuguccaag

SEQ ID NO: 2707 - RNA, 19 nt, Artificial Sequence
  Synthetic oligonucleotide
gucugggaacuguccaagg

SEQ ID NO: 2708 - RNA, 19 nt, Artificial Sequence
  Synthetic oligonucleotide
ucugggaacuguccaaggc

SEQ ID NO: 2709 - RNA, 19 nt, Artificial Sequence
  Synthetic oligonucleotide
cugggaacuguccaaggcc

SEQ ID NO: 2710 - RNA, 19 nt, Artificial Sequence
  Synthetic oligonucleotide
ugggaacuguccaaggcca

SEQ ID NO: 2711 - RNA, 19 nt, Artificial Sequence
  Synthetic oligonucleotide
gggaacuguccaaggccaa

SEQ ID NO: 2712 - RNA, 19 nt, Artificial Sequence
  Synthetic oligonucleotide
ggaacuguccaaggccaau

SEQ ID NO: 2713 - RNA, 19 nt, Artificial Sequence
  Synthetic oligonucleotide
gaacuguccaaggccaauu

SEQ ID NO: 2714 - RNA, 19 nt, Artificial Sequence
  Synthetic oligonucleotide
aauucccgcuuugcuacca

SEQ ID NO: 2715 - RNA, 19 nt, Artificial Sequence
  Synthetic oligonucleotide
ucccgcuuugcuaccacuu

SEQ ID NO: 2716 - RNA, 19 nt, Artificial Sequence
  Synthetic oligonucleotide
cccgcuuugcuaccacuuu

SEQ ID NO: 2717 - RNA, 19 nt, Artificial Sequence
  Synthetic oligonucleotide
ccgcuuugcuaccacuuuc

SEQ ID NO: 2718 - RNA, 19 nt, Artificial Sequence
  Synthetic oligonucleotide
cgcuuugcuaccacuuucu

SEQ ID NO: 2719 - RNA, 19 nt, Artificial Sequence
  Synthetic oligonucleotide
gcuuugcuaccacuuucua

SEQ ID NO: 2720 - RNA, 19 nt, Artificial Sequence
  Synthetic oligonucleotide
cuuugcuaccacuuucuau

SEQ ID NO: 2721 - RNA, 19 nt, Artificial Sequence
  Synthetic oligonucleotide
uuugcuaccacuuucuauc

SEQ ID NO: 2722 - RNA, 19 nt, Artificial Sequence
  Synthetic oligonucleotide
uugcuaccacuuucuauca

SEQ ID NO: 2723 - RNA, 19 nt, Artificial Sequence
  Synthetic oligonucleotide
ugcuaccacuuucuaucag

SEQ ID NO: 2724 - RNA, 19 nt, Artificial Sequence
  Synthetic oligonucleotide
caccuggcagauuccaaga

SEQ ID NO: 2725 - RNA, 19 nt, Artificial Sequence
  Synthetic oligonucleotide
ugauaacauuuuccuguca

SEQ ID NO: 2726 - RNA, 19 nt, Artificial Sequence
  Synthetic oligonucleotide
uaacauuuuccugucaccc

SEQ ID NO: 2727 - RNA, 19 nt, Artificial Sequence
  Synthetic oligonucleotide
acauuuuccugucaccccu

SEQ ID NO: 2728 - RNA, 19 nt, Artificial Sequence
  Synthetic oligonucleotide
ggcuuuugcuaugaccaag

SEQ ID NO: 2729 - RNA, 19 nt, Artificial Sequence
  Synthetic oligonucleotide
gcuuuugcuaugaccaagc

SEQ ID NO: 2730 - RNA, 19 nt, Artificial Sequence
  Synthetic oligonucleotide
cuuuugcuaugaccaagcu

SEQ ID NO: 2731 - RNA, 19 nt, Artificial Sequence
  Synthetic oligonucleotide
uuuugcuaugaccaagcug

SEQ ID NO: 2732 - RNA, 19 nt, Artificial Sequence
  Synthetic oligonucleotide
uuugcuaugaccaagcugg

SEQ ID NO: 2733 - RNA, 19 nt, Artificial Sequence
  Synthetic oligonucleotide
uugcuaugaccaagcuggg

SEQ ID NO: 2734 - RNA, 19 nt, Artificial Sequence
  Synthetic oligonucleotide
ugcuaugaccaagcugggu

SEQ ID NO: 2735 - RNA, 19 nt, Artificial Sequence
  Synthetic oligonucleotide
gcuaugaccaagcugggug

SEQ ID NO: 2736 - RNA, 19 nt, Artificial Sequence
  Synthetic oligonucleotide
cuaugaccaagcugggugc

SEQ ID NO: 2737 - RNA, 19 nt, Artificial Sequence
  Synthetic oligonucleotide
uaugaccaagcugggugcc

SEQ ID NO: 2738 - RNA, 19 nt, Artificial Sequence
  Synthetic oligonucleotide
augaccaagcugggugccu

SEQ ID NO: 2739 - RNA, 19 nt, Artificial Sequence
  Synthetic oligonucleotide
ugaccaagcugggugccug

SEQ ID NO: 2740 - RNA, 19 nt, Artificial Sequence
  Synthetic oligonucleotide
gaccaagcugggugccugu

SEQ ID NO: 2741 - RNA, 19 nt, Artificial Sequence
  Synthetic oligonucleotide
accaagcugggugccugua

SEQ ID NO: 2742 - RNA, 19 nt, Artificial Sequence
  Synthetic oligonucleotide
cagcaacugauggagguau

SEQ ID NO: 2743 - RNA, 19 nt, Artificial Sequence
  Synthetic oligonucleotide
agcaacugauggagguauu

SEQ ID NO: 2744 - RNA, 19 nt, Artificial Sequence
  Synthetic oligonucleotide
gcaacugauggagguauuu

SEQ ID NO: 2745 - RNA, 19 nt, Artificial Sequence
  Synthetic oligonucleotide
caacugauggagguauuua

SEQ ID NO: 2746 - RNA, 19 nt, Artificial Sequence
  Synthetic oligonucleotide
aacugauggagguauuuaa

SEQ ID NO: 2747 - RNA, 19 nt, Artificial Sequence
  Synthetic oligonucleotide
acugauggagguauuuaag

SEQ ID NO: 2748 - RNA, 19 nt, Artificial Sequence
  Synthetic oligonucleotide
cugauggagguauuuaagu

SEQ ID NO: 2749 - RNA, 19 nt, Artificial Sequence
  Synthetic oligonucleotide
ugauggagguauuuaaguu

SEQ ID NO: 2750 - RNA, 19 nt, Artificial Sequence
  Synthetic oligonucleotide
gauggagguauuuaaguuu

SEQ ID NO: 2751 - RNA, 19 nt, Artificial Sequence
  Synthetic oligonucleotide
auggagguauuuaaguuug

SEQ ID NO: 2752 - RNA, 19 nt, Artificial Sequence
  Synthetic oligonucleotide
uggagguauuuaaguuuga

SEQ ID NO: 2753 - RNA, 19 nt, Artificial Sequence
  Synthetic oligonucleotide
ggagguauuuaaguuugac

SEQ ID NO: 2754 - RNA, 19 nt, Artificial Sequence
  Synthetic oligonucleotide
gagguauuuaaguuugaca

SEQ ID NO: 2755 - RNA, 19 nt, Artificial Sequence
  Synthetic oligonucleotide
agguauuuaaguuugacac

SEQ ID NO: 2756 - RNA, 19 nt, Artificial Sequence
  Synthetic oligonucleotide
gguauuuaaguuugacacc

SEQ ID NO: 2757 - RNA, 19 nt, Artificial Sequence
  Synthetic oligonucleotide
guauuuaaguuugacacca

SEQ ID NO: 2758 - RNA, 19 nt, Artificial Sequence
  Synthetic oligonucleotide
uauuuaaguuugacaccau

SEQ ID NO: 2759 - RNA, 19 nt, Artificial Sequence
  Synthetic oligonucleotide
auuuaaguuugacaccaua

SEQ ID NO: 2760 - RNA, 19 nt, Artificial Sequence
  Synthetic oligonucleotide
uuuaaguuugacaccauau

SEQ ID NO: 2761 - RNA, 19 nt, Artificial Sequence
  Synthetic oligonucleotide
uuaaguuugacaccauauc

SEQ ID NO: 2762 - RNA, 19 nt, Artificial Sequence
  Synthetic oligonucleotide
uaaguuugacaccauaucu

SEQ ID NO: 2763 - RNA, 19 nt, Artificial Sequence
  Synthetic oligonucleotide
aaguuugacaccauaucug

SEQ ID NO: 2764 - RNA, 19 nt, Artificial Sequence
  Synthetic oligonucleotide
aguuugacaccauaucuga

SEQ ID NO: 2765 - RNA, 19 nt, Artificial Sequence
  Synthetic oligonucleotide
guuugacaccauaucugag

SEQ ID NO: 2766 - RNA, 19 nt, Artificial Sequence
  Synthetic oligonucleotide
uuugacaccauaucugaga

SEQ ID NO: 2767 - RNA, 19 nt, Artificial Sequence
  Synthetic oligonucleotide
uugacaccauaucugagaa

SEQ ID NO: 2768 - RNA, 19 nt, Artificial Sequence
  Synthetic oligonucleotide
ugacaccauaucugagaaa

SEQ ID NO: 2769 - RNA, 19 nt, Artificial Sequence
  Synthetic oligonucleotide
gacaccauaucugagaaaa

SEQ ID NO: 2770 - RNA, 19 nt, Artificial Sequence
  Synthetic oligonucleotide
acaccauaucugagaaaac

SEQ ID NO: 2771 - RNA, 19 nt, Artificial Sequence
  Synthetic oligonucleotide
caccauaucugagaaaaca

SEQ ID NO: 2772 - RNA, 19 nt, Artificial Sequence
  Synthetic oligonucleotide
accauaucugagaaaacau

SEQ ID NO: 2773 - RNA, 19 nt, Artificial Sequence
  Synthetic oligonucleotide
ccauaucugagaaaacauc

SEQ ID NO: 2774 - RNA, 19 nt, Artificial Sequence
  Synthetic oligonucleotide
cauaucugagaaaacaucu

SEQ ID NO: 2775 - RNA, 19 nt, Artificial Sequence
  Synthetic oligonucleotide
auaucugagaaaacaucug

SEQ ID NO: 2776 - RNA, 19 nt, Artificial Sequence
  Synthetic oligonucleotide
ucugagaaaacaucugauc

SEQ ID NO: 2777 - RNA, 19 nt, Artificial Sequence
  Synthetic oligonucleotide
cugagaaaacaucugauca

SEQ ID NO: 2778 - RNA, 19 nt, Artificial Sequence
  Synthetic oligonucleotide
ugagaaaacaucugaucag

SEQ ID NO: 2779 - RNA, 19 nt, Artificial Sequence
  Synthetic oligonucleotide
gagaaaacaucugaucaga

SEQ ID NO: 2780 - RNA, 19 nt, Artificial Sequence
  Synthetic oligonucleotide
gaucagauccacuucuucu

SEQ ID NO: 2781 - RNA, 19 nt, Artificial Sequence
  Synthetic oligonucleotide
ucagauccacuucuucuuu

SEQ ID NO: 2782 - RNA, 19 nt, Artificial Sequence
  Synthetic oligonucleotide
cagauccacuucuucuuug

SEQ ID NO: 2783 - RNA, 19 nt, Artificial Sequence
  Synthetic oligonucleotide
agauccacuucuucuuugc

SEQ ID NO: 2784 - RNA, 19 nt, Artificial Sequence
  Synthetic oligonucleotide
gauccacuucuucuuugcc

SEQ ID NO: 2785 - RNA, 19 nt, Artificial Sequence
  Synthetic oligonucleotide
auccacuucuucuuugcca

SEQ ID NO: 2786 - RNA, 19 nt, Artificial Sequence
  Synthetic oligonucleotide
uccacuucuucuuugccaa

SEQ ID NO: 2787 - RNA, 19 nt, Artificial Sequence
  Synthetic oligonucleotide
ccacuucuucuuugccaaa

SEQ ID NO: 2788 - RNA, 19 nt, Artificial Sequence
  Synthetic oligonucleotide
cacuucuucuuugccaaac

SEQ ID NO: 2789 - RNA, 19 nt, Artificial Sequence
  Synthetic oligonucleotide
acuucuucuuugccaaacu

SEQ ID NO: 2790 - RNA, 19 nt, Artificial Sequence
  Synthetic oligonucleotide
cuucuucuuugccaaacug

SEQ ID NO: 2791 - RNA, 19 nt, Artificial Sequence
  Synthetic oligonucleotide
uucuucuuugccaaacuga

SEQ ID NO: 2792 - RNA, 19 nt, Artificial Sequence
  Synthetic oligonucleotide
ucuucuuugccaaacugaa

SEQ ID NO: 2793 - RNA, 19 nt, Artificial Sequence
  Synthetic oligonucleotide
cuucuuugccaaacugaac

SEQ ID NO: 2794 - RNA, 19 nt, Artificial Sequence
  Synthetic oligonucleotide
uucuuugccaaacugaacu

SEQ ID NO: 2795 - RNA, 19 nt, Artificial Sequence
  Synthetic oligonucleotide
ucuuugccaaacugaacug

SEQ ID NO: 2796 - RNA, 19 nt, Artificial Sequence
  Synthetic oligonucleotide
cuuugccaaacugaacugc

SEQ ID NO: 2797 - RNA, 19 nt, Artificial Sequence
  Synthetic oligonucleotide
uuugccaaacugaacugcc

SEQ ID NO: 2798 - RNA, 19 nt, Artificial Sequence
  Synthetic oligonucleotide
uugccaaacugaacugccg

SEQ ID NO: 2799 - RNA, 19 nt, Artificial Sequence
  Synthetic oligonucleotide
ugccaaacugaacugccga

SEQ ID NO: 2800 - RNA, 19 nt, Artificial Sequence
  Synthetic oligonucleotide
gccaaacugaacugccgac

SEQ ID NO: 2801 - RNA, 19 nt, Artificial Sequence
  Synthetic oligonucleotide
ccaaacugaacugccgacu

SEQ ID NO: 2802 - RNA, 19 nt, Artificial Sequence
  Synthetic oligonucleotide
caaacugaacugccgacuc

SEQ ID NO: 2803 - RNA, 19 nt, Artificial Sequence
  Synthetic oligonucleotide
aaacugaacugccgacucu

SEQ ID NO: 2804 - RNA, 19 nt, Artificial Sequence
  Synthetic oligonucleotide
aacugaacugccgacucua

SEQ ID NO: 2805 - RNA, 19 nt, Artificial Sequence
  Synthetic oligonucleotide
acugaacugccgacucuau

SEQ ID NO: 2806 - RNA, 19 nt, Artificial Sequence
  Synthetic oligonucleotide
cugaacugccgacucuauc

SEQ ID NO: 2807 - RNA, 19 nt, Artificial Sequence
  Synthetic oligonucleotide
ugaacugccgacucuaucg

SEQ ID NO: 2808 - RNA, 19 nt, Artificial Sequence
  Synthetic oligonucleotide
gaacugccgacucuaucga

SEQ ID NO: 2809 - RNA, 19 nt, Artificial Sequence
  Synthetic oligonucleotide
aacugccgacucuaucgaa

SEQ ID NO: 2810 - RNA, 19 nt, Artificial Sequence
  Synthetic oligonucleotide
acugccgacucuaucgaaa

SEQ ID NO: 2811 - RNA, 19 nt, Artificial Sequence
  Synthetic oligonucleotide
cugccgacucuaucgaaaa

SEQ ID NO: 2812 - RNA, 19 nt, Artificial Sequence
  Synthetic oligonucleotide
ugccgacucuaucgaaaag

SEQ ID NO: 2813 - RNA, 19 nt, Artificial Sequence
  Synthetic oligonucleotide
gccgacucuaucgaaaagc

SEQ ID NO: 2814 - RNA, 19 nt, Artificial Sequence
  Synthetic oligonucleotide
ccgacucuaucgaaaagcc

SEQ ID NO: 2815 - RNA, 19 nt, Artificial Sequence
  Synthetic oligonucleotide
cgacucuaucgaaaagcca

SEQ ID NO: 2816 - RNA, 19 nt, Artificial Sequence
  Synthetic oligonucleotide
gacucuaucgaaaagccaa

SEQ ID NO: 2817 - RNA, 19 nt, Artificial Sequence
  Synthetic oligonucleotide
acucuaucgaaaagccaac

SEQ ID NO: 2818 - RNA, 19 nt, Artificial Sequence
  Synthetic oligonucleotide
cucuaucgaaaagccaaca

SEQ ID NO: 2819 - RNA, 19 nt, Artificial Sequence
  Synthetic oligonucleotide
gaaaagccaacaaauccuc

SEQ ID NO: 2820 - RNA, 19 nt, Artificial Sequence
  Synthetic oligonucleotide
aaaagccaacaaauccucc

SEQ ID NO: 2821 - RNA, 19 nt, Artificial Sequence
  Synthetic oligonucleotide
agccaacaaauccuccaag

SEQ ID NO: 2822 - RNA, 19 nt, Artificial Sequence
  Synthetic oligonucleotide
gccaacaaauccuccaagu

SEQ ID NO: 2823 - RNA, 19 nt, Artificial Sequence
  Synthetic oligonucleotide
ccaacaaauccuccaaguu

SEQ ID NO: 2824 - RNA, 19 nt, Artificial Sequence
  Synthetic oligonucleotide
caacaaauccuccaaguua

SEQ ID NO: 2825 - RNA, 19 nt, Artificial Sequence
  Synthetic oligonucleotide
aacaaauccuccaaguuag

SEQ ID NO: 2826 - RNA, 19 nt, Artificial Sequence
  Synthetic oligonucleotide
acaaauccuccaaguuagu

SEQ ID NO: 2827 - RNA, 19 nt, Artificial Sequence
  Synthetic oligonucleotide
aaguuaguaucagccaauc

SEQ ID NO: 2828 - RNA, 19 nt, Artificial Sequence
  Synthetic oligonucleotide
uaguaucagccaaucgccu

SEQ ID NO: 2829 - RNA, 19 nt, Artificial Sequence
  Synthetic oligonucleotide
ucagccaaucgccuuuuug

SEQ ID NO: 2830 - RNA, 19 nt, Artificial Sequence
  Synthetic oligonucleotide
cagccaaucgccuuuuugg

SEQ ID NO: 2831 - RNA, 19 nt, Artificial Sequence
  Synthetic oligonucleotide
agccaaucgccuuuuugga

SEQ ID NO: 2832 - RNA, 19 nt, Artificial Sequence
  Synthetic oligonucleotide
aaucgccuuuuuggagaca

SEQ ID NO: 2833 - RNA, 19 nt, Artificial Sequence
  Synthetic oligonucleotide
ucgccuuuuuggagacaaa

SEQ ID NO: 2834 - RNA, 19 nt, Artificial Sequence
  Synthetic oligonucleotide
cgccuuuuuggagacaaau

SEQ ID NO: 2835 - RNA, 19 nt, Artificial Sequence
  Synthetic oligonucleotide
gccuuuuuggagacaaauc

SEQ ID NO: 2836 - RNA, 19 nt, Artificial Sequence
  Synthetic oligonucleotide
ccuuuuuggagacaaaucc

SEQ ID NO: 2837 - RNA, 19 nt, Artificial Sequence
  Synthetic oligonucleotide
cuuuuuggagacaaauccc

SEQ ID NO: 2838 - RNA, 19 nt, Artificial Sequence
  Synthetic oligonucleotide
uuggagacaaaucccuuac

SEQ ID NO: 2839 - RNA, 19 nt, Artificial Sequence
  Synthetic oligonucleotide
uggagacaaaucccuuacc

SEQ ID NO: 2840 - RNA, 19 nt, Artificial Sequence
  Synthetic oligonucleotide
ggagacaaaucccuuaccu

SEQ ID NO: 2841 - RNA, 19 nt, Artificial Sequence
  Synthetic oligonucleotide
gagacaaaucccuuaccuu

SEQ ID NO: 2842 - RNA, 19 nt, Artificial Sequence
  Synthetic oligonucleotide
agacaaaucccuuaccuuc

SEQ ID NO: 2843 - RNA, 19 nt, Artificial Sequence
  Synthetic oligonucleotide
gacaaaucccuuaccuuca

SEQ ID NO: 2844 - RNA, 19 nt, Artificial Sequence
  Synthetic oligonucleotide
caaaucccuuaccuucaau

SEQ ID NO: 2845 - RNA, 19 nt, Artificial Sequence
  Synthetic oligonucleotide
aaaucccuuaccuucaaug

SEQ ID NO: 2846 - RNA, 19 nt, Artificial Sequence
  Synthetic oligonucleotide
aaucccuuaccuucaauga

SEQ ID NO: 2847 - RNA, 19 nt, Artificial Sequence
  Synthetic oligonucleotide
uaccuucaaugagaccuac

SEQ ID NO: 2848 - RNA, 19 nt, Artificial Sequence
  Synthetic oligonucleotide
uucaaugagaccuaccagg

SEQ ID NO: 2849 - RNA, 19 nt, Artificial Sequence
  Synthetic oligonucleotide
ucaaugagaccuaccagga

SEQ ID NO: 2850 - RNA, 19 nt, Artificial Sequence
  Synthetic oligonucleotide
caaugagaccuaccaggac

SEQ ID NO: 2851 - RNA, 19 nt, Artificial Sequence
  Synthetic oligonucleotide
augagaccuaccaggacau

SEQ ID NO: 2852 - RNA, 19 nt, Artificial Sequence
  Synthetic oligonucleotide
gagaccuaccaggacauca

SEQ ID NO: 2853 - RNA, 19 nt, Artificial Sequence
  Synthetic oligonucleotide
ccuaccaggacaucaguga

SEQ ID NO: 2854 - RNA, 19 nt, Artificial Sequence
  Synthetic oligonucleotide
cuaccaggacaucagugag

SEQ ID NO: 2855 - RNA, 19 nt, Artificial Sequence
  Synthetic oligonucleotide
uaccaggacaucagugagu

SEQ ID NO: 2856 - RNA, 19 nt, Artificial Sequence
  Synthetic oligonucleotide
accaggacaucagugaguu

SEQ ID NO: 2857 - RNA, 19 nt, Artificial Sequence
  Synthetic oligonucleotide
ccaggacaucagugaguug

SEQ ID NO: 2858 - RNA, 19 nt, Artificial Sequence
  Synthetic oligonucleotide
caggacaucagugaguugg

SEQ ID NO: 2859 - RNA, 19 nt, Artificial Sequence
  Synthetic oligonucleotide
aggacaucagugaguuggu

SEQ ID NO: 2860 - RNA, 19 nt, Artificial Sequence
  Synthetic oligonucleotide
ggacaucagugaguuggua

SEQ ID NO: 2861 - RNA, 19 nt, Artificial Sequence
  Synthetic oligonucleotide
gacaucagugaguugguau

SEQ ID NO: 2862 - RNA, 19 nt, Artificial Sequence
  Synthetic oligonucleotide
auauggagccaagcuccag

SEQ ID NO: 2863 - RNA, 19 nt, Artificial Sequence
  Synthetic oligonucleotide
uauggagccaagcuccagc

SEQ ID NO: 2864 - RNA, 19 nt, Artificial Sequence
  Synthetic oligonucleotide
auggagccaagcuccagcc

SEQ ID NO: 2865 - RNA, 19 nt, Artificial Sequence
  Synthetic oligonucleotide
uggagccaagcuccagccc

SEQ ID NO: 2866 - RNA, 19 nt, Artificial Sequence
  Synthetic oligonucleotide
ggagccaagcuccagcccc

SEQ ID NO: 2867 - RNA, 19 nt, Artificial Sequence
  Synthetic oligonucleotide
gagccaagcuccagccccu

SEQ ID NO: 2868 - RNA, 19 nt, Artificial Sequence
  Synthetic oligonucleotide
agccaagcuccagccccug

SEQ ID NO: 2869 - RNA, 19 nt, Artificial Sequence
  Synthetic oligonucleotide
gccaagcuccagccccugg

SEQ ID NO: 2870 - RNA, 19 nt, Artificial Sequence
  Synthetic oligonucleotide
ccaagcuccagccccugga

SEQ ID NO: 2871 - RNA, 19 nt, Artificial Sequence
  Synthetic oligonucleotide
caagcuccagccccuggac

SEQ ID NO: 2872 - RNA, 19 nt, Artificial Sequence
  Synthetic oligonucleotide
aagcuccagccccuggacu

SEQ ID NO: 2873 - RNA, 19 nt, Artificial Sequence
  Synthetic oligonucleotide
agcuccagccccuggacuu

SEQ ID NO: 2874 - RNA, 19 nt, Artificial Sequence
  Synthetic oligonucleotide
gcuccagccccuggacuuc

SEQ ID NO: 2875 - RNA, 19 nt, Artificial Sequence
  Synthetic oligonucleotide
cuccagccccuggacuuca

SEQ ID NO: 2876 - RNA, 19 nt, Artificial Sequence
  Synthetic oligonucleotide
uccagccccuggacuucaa

SEQ ID NO: 2877 - RNA, 19 nt, Artificial Sequence
  Synthetic oligonucleotide
ccagccccuggacuucaag

SEQ ID NO: 2878 - RNA, 19 nt, Artificial Sequence
  Synthetic oligonucleotide
cagccccuggacuucaagg

SEQ ID NO: 2879 - RNA, 19 nt, Artificial Sequence
  Synthetic oligonucleotide
agccccuggacuucaagga

SEQ ID NO: 2880 - RNA, 19 nt, Artificial Sequence
  Synthetic oligonucleotide
cuggacuucaaggaaaaug

SEQ ID NO: 2881 - RNA, 19 nt, Artificial Sequence
  Synthetic oligonucleotide
uggacuucaaggaaaaugc

SEQ ID NO: 2882 - RNA, 19 nt, Artificial Sequence
  Synthetic oligonucleotide
ggacuucaaggaaaaugca

SEQ ID NO: 2883 - RNA, 19 nt, Artificial Sequence
  Synthetic oligonucleotide
gacuucaaggaaaaugcag

SEQ ID NO: 2884 - RNA, 19 nt, Artificial Sequence
  Synthetic oligonucleotide
cuucaaggaaaaugcagag

SEQ ID NO: 2885 - RNA, 19 nt, Artificial Sequence
  Synthetic oligonucleotide
uucaaggaaaaugcagagc

SEQ ID NO: 2886 - RNA, 19 nt, Artificial Sequence
  Synthetic oligonucleotide
ucaaggaaaaugcagagca

SEQ ID NO: 2887 - RNA, 19 nt, Artificial Sequence
  Synthetic oligonucleotide
caaggaaaaugcagagcaa

SEQ ID NO: 2888 - RNA, 19 nt, Artificial Sequence
  Synthetic oligonucleotide
ccaucaacaaauggguguc

SEQ ID NO: 2889 - RNA, 19 nt, Artificial Sequence
  Synthetic oligonucleotide
caucaacaaaugggugucc

SEQ ID NO: 2890 - RNA, 19 nt, Artificial Sequence
  Synthetic oligonucleotide
acaaauggguguccaauaa

SEQ ID NO: 2891 - RNA, 19 nt, Artificial Sequence
  Synthetic oligonucleotide
ugagcucacuguucuggug

SEQ ID NO: 2892 - RNA, 19 nt, Artificial Sequence
  Synthetic oligonucleotide
agcucacuguucuggugcu

SEQ ID NO: 2893 - RNA, 19 nt, Artificial Sequence
  Synthetic oligonucleotide
gcucacuguucuggugcug

SEQ ID NO: 2894 - RNA, 19 nt, Artificial Sequence
  Synthetic oligonucleotide
cucacuguucuggugcugg

SEQ ID NO: 2895 - RNA, 19 nt, Artificial Sequence
  Synthetic oligonucleotide
ucacuguucuggugcuggu

SEQ ID NO: 2896 - RNA, 19 nt, Artificial Sequence
  Synthetic oligonucleotide
cacuguucuggugcugguu

SEQ ID NO: 2897 - RNA, 19 nt, Artificial Sequence
  Synthetic oligonucleotide
acuguucuggugcugguua

SEQ ID NO: 2898 - RNA, 19 nt, Artificial Sequence
  Synthetic oligonucleotide
cuguucuggugcugguuaa

SEQ ID NO: 2899 - RNA, 19 nt, Artificial Sequence
  Synthetic oligonucleotide
uguucuggugcugguuaac

SEQ ID NO: 2900 - RNA, 19 nt, Artificial Sequence
  Synthetic oligonucleotide
guucuggugcugguuaaca

SEQ ID NO: 2901 - RNA, 19 nt, Artificial Sequence
  Synthetic oligonucleotide
uucuggugcugguuaacac

SEQ ID NO: 2902 - RNA, 19 nt, Artificial Sequence
  Synthetic oligonucleotide
ucuggugcugguuaacacc

SEQ ID NO: 2903 - RNA, 19 nt, Artificial Sequence
  Synthetic oligonucleotide
cuggugcugguuaacacca

SEQ ID NO: 2904 - RNA, 19 nt, Artificial Sequence
  Synthetic oligonucleotide
uggugcugguuaacaccau

SEQ ID NO: 2905 - RNA, 19 nt, Artificial Sequence
  Synthetic oligonucleotide
ggugcugguuaacaccauu

SEQ ID NO: 2906 - RNA, 19 nt, Artificial Sequence
  Synthetic oligonucleotide
gugcugguuaacaccauuu

SEQ ID NO: 2907 - RNA, 19 nt, Artificial Sequence
  Synthetic oligonucleotide
ugcugguuaacaccauuua

SEQ ID NO: 2908 - RNA, 19 nt, Artificial Sequence
  Synthetic oligonucleotide
gcugguuaacaccauuuac

SEQ ID NO: 2909 - RNA, 19 nt, Artificial Sequence
  Synthetic oligonucleotide
cugguuaacaccauuuacu

SEQ ID NO: 2910 - RNA, 19 nt, Artificial Sequence
  Synthetic oligonucleotide
ugguuaacaccauuuacuu

SEQ ID NO: 2911 - RNA, 19 nt, Artificial Sequence
  Synthetic oligonucleotide
gguuaacaccauuuacuuc

SEQ ID NO: 2912 - RNA, 19 nt, Artificial Sequence
  Synthetic oligonucleotide
guuaacaccauuuacuuca

SEQ ID NO: 2913 - RNA, 19 nt, Artificial Sequence
  Synthetic oligonucleotide
uuaacaccauuuacuucaa

SEQ ID NO: 2914 - RNA, 19 nt, Artificial Sequence
  Synthetic oligonucleotide
uaacaccauuuacuucaag

SEQ ID NO: 2915 - RNA, 19 nt, Artificial Sequence
  Synthetic oligonucleotide
aacaccauuuacuucaagg

SEQ ID NO: 2916 - RNA, 19 nt, Artificial Sequence
  Synthetic oligonucleotide
acaccauuuacuucaaggg

SEQ ID NO: 2917 - RNA, 19 nt, Artificial Sequence
  Synthetic oligonucleotide
caccauuuacuucaagggc

SEQ ID NO: 2918 - RNA, 19 nt, Artificial Sequence
  Synthetic oligonucleotide
accauuuacuucaagggcc

SEQ ID NO: 2919 - RNA, 19 nt, Artificial Sequence
  Synthetic oligonucleotide
ccauuuacuucaagggccu

SEQ ID NO: 2920 - RNA, 19 nt, Artificial Sequence
  Synthetic oligonucleotide
cauuuacuucaagggccug

SEQ ID NO: 2921 - RNA, 19 nt, Artificial Sequence
  Synthetic oligonucleotide
auuuacuucaagggccugu

SEQ ID NO: 2922 - RNA, 19 nt, Artificial Sequence
  Synthetic oligonucleotide
uuuacuucaagggccugug

SEQ ID NO: 2923 - RNA, 19 nt, Artificial Sequence
  Synthetic oligonucleotide
uuacuucaagggccugugg

SEQ ID NO: 2924 - RNA, 19 nt, Artificial Sequence
  Synthetic oligonucleotide
uacuucaagggccugugga

SEQ ID NO: 2925 - RNA, 19 nt, Artificial Sequence
  Synthetic oligonucleotide
acuucaagggccuguggaa

SEQ ID NO: 2926 - RNA, 19 nt, Artificial Sequence
  Synthetic oligonucleotide
cuucaagggccuguggaag

SEQ ID NO: 2927 - RNA, 19 nt, Artificial Sequence
  Synthetic oligonucleotide
uucaagggccuguggaagu

SEQ ID NO: 2928 - RNA, 19 nt, Artificial Sequence
  Synthetic oligonucleotide
ucaagggccuguggaaguc

SEQ ID NO: 2929 - RNA, 19 nt, Artificial Sequence
  Synthetic oligonucleotide
caagggccuguggaaguca

SEQ ID NO: 2930 - RNA, 19 nt, Artificial Sequence
  Synthetic oligonucleotide
aagggccuguggaagucaa

SEQ ID NO: 2931 - RNA, 19 nt, Artificial Sequence
  Synthetic oligonucleotide
agggccuguggaagucaaa

SEQ ID NO: 2932 - RNA, 19 nt, Artificial Sequence
  Synthetic oligonucleotide
gggccuguggaagucaaag

SEQ ID NO: 2933 - RNA, 19 nt, Artificial Sequence
  Synthetic oligonucleotide
ggccuguggaagucaaagu

SEQ ID NO: 2934 - RNA, 19 nt, Artificial Sequence
  Synthetic oligonucleotide
gccuguggaagucaaaguu

SEQ ID NO: 2935 - RNA, 19 nt, Artificial Sequence
  Synthetic oligonucleotide
ccuguggaagucaaaguuc

SEQ ID NO: 2936 - RNA, 19 nt, Artificial Sequence
  Synthetic oligonucleotide
cuguggaagucaaaguuca

SEQ ID NO: 2937 - RNA, 19 nt, Artificial Sequence
  Synthetic oligonucleotide
uguggaagucaaaguucag

SEQ ID NO: 2938 - RNA, 19 nt, Artificial Sequence
  Synthetic oligonucleotide
guggaagucaaaguucagc

SEQ ID NO: 2939 - RNA, 19 nt, Artificial Sequence
  Synthetic oligonucleotide
uggaagucaaaguucagcc

SEQ ID NO: 2940 - RNA, 19 nt, Artificial Sequence
  Synthetic oligonucleotide
ggaagucaaaguucagccc

SEQ ID NO: 2941 - RNA, 19 nt, Artificial Sequence
  Synthetic oligonucleotide
gaagucaaaguucagcccu

SEQ ID NO: 2942 - RNA, 19 nt, Artificial Sequence
  Synthetic oligonucleotide
aagucaaaguucagcccug

SEQ ID NO: 2943 - RNA, 19 nt, Artificial Sequence
  Synthetic oligonucleotide
acaaggcugauggagaguc

SEQ ID NO: 2944 - RNA, 19 nt, Artificial Sequence
  Synthetic oligonucleotide
ugauggagagucguguuca

SEQ ID NO: 2945 - RNA, 19 nt, Artificial Sequence
  Synthetic oligonucleotide
gauggagagucguguucag

SEQ ID NO: 2946 - RNA, 19 nt, Artificial Sequence
  Synthetic oligonucleotide
ucuaugauguaccaggaag

SEQ ID NO: 2947 - RNA, 19 nt, Artificial Sequence
  Synthetic oligonucleotide
cuaugauguaccaggaagg

SEQ ID NO: 2948 - RNA, 19 nt, Artificial Sequence
  Synthetic oligonucleotide
uaugauguaccaggaaggc

SEQ ID NO: 2949 - RNA, 19 nt, Artificial Sequence
  Synthetic oligonucleotide
augauguaccaggaaggca

SEQ ID NO: 2950 - RNA, 19 nt, Artificial Sequence
  Synthetic oligonucleotide
gauguaccaggaaggcaag

SEQ ID NO: 2951 - RNA, 19 nt, Artificial Sequence
  Synthetic oligonucleotide
cccaggugcuugaguugcc

SEQ ID NO: 2952 - RNA, 19 nt, Artificial Sequence
  Synthetic oligonucleotide
aggugcuugaguugcccuu

SEQ ID NO: 2953 - RNA, 19 nt, Artificial Sequence
  Synthetic oligonucleotide
ggugcuugaguugcccuuc

SEQ ID NO: 2954 - RNA, 19 nt, Artificial Sequence
  Synthetic oligonucleotide
gugcuugaguugcccuuca

SEQ ID NO: 2955 - RNA, 19 nt, Artificial Sequence
  Synthetic oligonucleotide
aggugaugacaucaccaug

SEQ ID NO: 2956 - RNA, 19 nt, Artificial Sequence
  Synthetic oligonucleotide
ggugaugacaucaccaugg

SEQ ID NO: 2957 - RNA, 19 nt, Artificial Sequence
  Synthetic oligonucleotide
uugcccaagccugagaaga

SEQ ID NO: 2958 - RNA, 19 nt, Artificial Sequence
  Synthetic oligonucleotide
ugcccaagccugagaagag

SEQ ID NO: 2959 - RNA, 19 nt, Artificial Sequence
  Synthetic oligonucleotide
gcccaagccugagaagagc

SEQ ID NO: 2960 - RNA, 19 nt, Artificial Sequence
  Synthetic oligonucleotide
cccaagccugagaagagcc

SEQ ID NO: 2961 - RNA, 19 nt, Artificial Sequence
  Synthetic oligonucleotide
ccaagccugagaagagccu

SEQ ID NO: 2962 - RNA, 19 nt, Artificial Sequence
  Synthetic oligonucleotide
caagccugagaagagccug

SEQ ID NO: 2963 - RNA, 19 nt, Artificial Sequence
  Synthetic oligonucleotide
aagccugagaagagccugg

SEQ ID NO: 2964 - RNA, 19 nt, Artificial Sequence
  Synthetic oligonucleotide
agccugagaagagccuggc

SEQ ID NO: 2965 - RNA, 19 nt, Artificial Sequence
  Synthetic oligonucleotide
gccugagaagagccuggcc

SEQ ID NO: 2966 - RNA, 19 nt, Artificial Sequence
  Synthetic oligonucleotide
ccugagaagagccuggcca

SEQ ID NO: 2967 - RNA, 19 nt, Artificial Sequence
  Synthetic oligonucleotide
cugagaagagccuggccaa

SEQ ID NO: 2968 - RNA, 19 nt, Artificial Sequence
  Synthetic oligonucleotide
ugagaagagccuggccaag

SEQ ID NO: 2969 - RNA, 19 nt, Artificial Sequence
  Synthetic oligonucleotide
gagaagagccuggccaagg

SEQ ID NO: 2970 - RNA, 19 nt, Artificial Sequence
  Synthetic oligonucleotide
ggugguccacaugccccgc

SEQ ID NO: 2971 - RNA, 19 nt, Artificial Sequence
  Synthetic oligonucleotide
gugguccacaugccccgcu

SEQ ID NO: 2972 - RNA, 19 nt, Artificial Sequence
  Synthetic oligonucleotide
ugguccacaugccccgcuu

SEQ ID NO: 2973 - RNA, 19 nt, Artificial Sequence
  Synthetic oligonucleotide
gguccacaugccccgcuuc

SEQ ID NO: 2974 - RNA, 19 nt, Artificial Sequence
  Synthetic oligonucleotide
guccacaugccccgcuucc

SEQ ID NO: 2975 - RNA, 19 nt, Artificial Sequence
  Synthetic oligonucleotide
uccacaugccccgcuuccg

SEQ ID NO: 2976 - RNA, 19 nt, Artificial Sequence
  Synthetic oligonucleotide
ccacaugccccgcuuccgc

SEQ ID NO: 2977 - RNA, 19 nt, Artificial Sequence
  Synthetic oligonucleotide
caguuugaaggagcagcug

SEQ ID NO: 2978 - RNA, 19 nt, Artificial Sequence
  Synthetic oligonucleotide
aguuugaaggagcagcugc

SEQ ID NO: 2979 - RNA, 19 nt, Artificial Sequence
  Synthetic oligonucleotide
uugaaggagcagcugcaag

SEQ ID NO: 2980 - RNA, 19 nt, Artificial Sequence
  Synthetic oligonucleotide
ugaaggagcagcugcaaga

SEQ ID NO: 2981 - RNA, 19 nt, Artificial Sequence
  Synthetic oligonucleotide
gaaggagcagcugcaagac

SEQ ID NO: 2982 - RNA, 19 nt, Artificial Sequence
  Synthetic oligonucleotide
aaggagcagcugcaagaca

SEQ ID NO: 2983 - RNA, 19 nt, Artificial Sequence
  Synthetic oligonucleotide
aggagcagcugcaagacau

SEQ ID NO: 2984 - RNA, 19 nt, Artificial Sequence
  Synthetic oligonucleotide
ggagcagcugcaagacaug

SEQ ID NO: 2985 - RNA, 19 nt, Artificial Sequence
  Synthetic oligonucleotide
gagcagcugcaagacaugg

SEQ ID NO: 2986 - RNA, 19 nt, Artificial Sequence
  Synthetic oligonucleotide
agcagcugcaagacauggg

SEQ ID NO: 2987 - RNA, 19 nt, Artificial Sequence
  Synthetic oligonucleotide
gcagcugcaagacaugggc

SEQ ID NO: 2988 - RNA, 19 nt, Artificial Sequence
  Synthetic oligonucleotide
cagcugcaagacaugggcc

SEQ ID NO: 2989 - RNA, 19 nt, Artificial Sequence
  Synthetic oligonucleotide
cuugucgaucuguucagcc

SEQ ID NO: 2990 - RNA, 19 nt, Artificial Sequence
  Synthetic oligonucleotide
ugucgaucuguucagcccu

SEQ ID NO: 2991 - RNA, 19 nt, Artificial Sequence
  Synthetic oligonucleotide
gucgaucuguucagcccug

SEQ ID NO: 2992 - RNA, 19 nt, Artificial Sequence
  Synthetic oligonucleotide
cgaucuguucagcccugaa

SEQ ID NO: 2993 - RNA, 19 nt, Artificial Sequence
  Synthetic oligonucleotide
ucuguucagcccugaaaag

SEQ ID NO: 2994 - RNA, 19 nt, Artificial Sequence
  Synthetic oligonucleotide
uguucagcccugaaaaguc

SEQ ID NO: 2995 - RNA, 19 nt, Artificial Sequence
  Synthetic oligonucleotide
aaaaguccaaacucccagg

SEQ ID NO: 2996 - RNA, 19 nt, Artificial Sequence
  Synthetic oligonucleotide
aaaguccaaacucccaggu

SEQ ID NO: 2997 - RNA, 19 nt, Artificial Sequence
  Synthetic oligonucleotide
aguccaaacucccagguau

SEQ ID NO: 2998 - RNA, 19 nt, Artificial Sequence
  Synthetic oligonucleotide
uccaaacucccagguauug

SEQ ID NO: 2999 - RNA, 19 nt, Artificial Sequence
  Synthetic oligonucleotide
ccaaacucccagguauugu

SEQ ID NO: 3000 - RNA, 19 nt, Artificial Sequence
  Synthetic oligonucleotide
caaacucccagguauuguu

SEQ ID NO: 3001 - RNA, 19 nt, Artificial Sequence
  Synthetic oligonucleotide
aaacucccagguauuguug

SEQ ID NO: 3002 - RNA, 19 nt, Artificial Sequence
  Synthetic oligonucleotide
ccauaaggcauuucuugag

SEQ ID NO: 3003 - RNA, 19 nt, Artificial Sequence
  Synthetic oligonucleotide
cauaaggcauuucuugagg

SEQ ID NO: 3004 - RNA, 19 nt, Artificial Sequence
  Synthetic oligonucleotide
auaaggcauuucuugaggu

SEQ ID NO: 3005 - RNA, 19 nt, Artificial Sequence
  Synthetic oligonucleotide
uaaggcauuucuugaggua

SEQ ID NO: 3006 - RNA, 19 nt, Artificial Sequence
  Synthetic oligonucleotide
aaggcauuucuugagguaa

SEQ ID NO: 3007 - RNA, 19 nt, Artificial Sequence
  Synthetic oligonucleotide
aggcauuucuugagguaaa

SEQ ID NO: 3008 - RNA, 19 nt, Artificial Sequence
  Synthetic oligonucleotide
ggcauuucuugagguaaau

SEQ ID NO: 3009 - RNA, 19 nt, Artificial Sequence
  Synthetic oligonucleotide
gcauuucuugagguaaaug

SEQ ID NO: 3010 - RNA, 19 nt, Artificial Sequence
  Synthetic oligonucleotide
uugagguaaaugaagaagg

SEQ ID NO: 3011 - RNA, 19 nt, Artificial Sequence
  Synthetic oligonucleotide
ugagguaaaugaagaaggc

SEQ ID NO: 3012 - RNA, 19 nt, Artificial Sequence
  Synthetic oligonucleotide
gagguaaaugaagaaggca

SEQ ID NO: 3013 - RNA, 19 nt, Artificial Sequence
  Synthetic oligonucleotide
agguaaaugaagaaggcag

SEQ ID NO: 3014 - RNA, 19 nt, Artificial Sequence
  Synthetic oligonucleotide
gguaaaugaagaaggcagu

SEQ ID NO: 3015 - RNA, 19 nt, Artificial Sequence
  Synthetic oligonucleotide
guaaaugaagaaggcagug

SEQ ID NO: 3016 - RNA, 19 nt, Artificial Sequence
  Synthetic oligonucleotide
uaaaugaagaaggcaguga

SEQ ID NO: 3017 - RNA, 19 nt, Artificial Sequence
  Synthetic oligonucleotide
gaagaaggcagugaagcag

SEQ ID NO: 3018 - RNA, 19 nt, Artificial Sequence
  Synthetic oligonucleotide
gaaggcagugaagcagcug

SEQ ID NO: 3019 - RNA, 19 nt, Artificial Sequence
  Synthetic oligonucleotide
aaggcagugaagcagcugc

SEQ ID NO: 3020 - RNA, 19 nt, Artificial Sequence
  Synthetic oligonucleotide
gaagcagcugcaaguaccg

SEQ ID NO: 3021 - RNA, 19 nt, Artificial Sequence
  Synthetic oligonucleotide
caacaggccuuuccugguu

SEQ ID NO: 3022 - RNA, 19 nt, Artificial Sequence
  Synthetic oligonucleotide
aacaggccuuuccugguuu

SEQ ID NO: 3023 - RNA, 19 nt, Artificial Sequence
  Synthetic oligonucleotide
acaggccuuuccugguuuu

SEQ ID NO: 3024 - RNA, 19 nt, Artificial Sequence
  Synthetic oligonucleotide
caggccuuuccugguuuuu

SEQ ID NO: 3025 - RNA, 19 nt, Artificial Sequence
  Synthetic oligonucleotide
aggccuuuccugguuuuua

SEQ ID NO: 3026 - RNA, 19 nt, Artificial Sequence
  Synthetic oligonucleotide
ggccuuuccugguuuuuau

SEQ ID NO: 3027 - RNA, 19 nt, Artificial Sequence
  Synthetic oligonucleotide
ccuuuccugguuuuuauaa

SEQ ID NO: 3028 - RNA, 19 nt, Artificial Sequence
  Synthetic oligonucleotide
cuuuccugguuuuuauaag

SEQ ID NO: 3029 - RNA, 19 nt, Artificial Sequence
  Synthetic oligonucleotide
uuuccugguuuuuauaaga

SEQ ID NO: 3030 - RNA, 19 nt, Artificial Sequence
  Synthetic oligonucleotide
uuccugguuuuuauaagag

SEQ ID NO: 3031 - RNA, 19 nt, Artificial Sequence
  Synthetic oligonucleotide
uccugguuuuuauaagaga

SEQ ID NO: 3032 - RNA, 19 nt, Artificial Sequence
  Synthetic oligonucleotide
ccugguuuuuauaagagaa

SEQ ID NO: 3033 - RNA, 19 nt, Artificial Sequence
  Synthetic oligonucleotide
cugguuuuuauaagagaag

SEQ ID NO: 3034 - RNA, 19 nt, Artificial Sequence
  Synthetic oligonucleotide
ugguuuuuauaagagaagu

SEQ ID NO: 3035 - RNA, 19 nt, Artificial Sequence
  Synthetic oligonucleotide
gguuuuuauaagagaaguu

SEQ ID NO: 3036 - RNA, 19 nt, Artificial Sequence
  Synthetic oligonucleotide
guuuuuauaagagaaguuc

SEQ ID NO: 3037 - RNA, 19 nt, Artificial Sequence
  Synthetic oligonucleotide
uuuuuauaagagaaguucc

SEQ ID NO: 3038 - RNA, 19 nt, Artificial Sequence
  Synthetic oligonucleotide
uuuuauaagagaaguuccu

SEQ ID NO: 3039 - RNA, 19 nt, Artificial Sequence
  Synthetic oligonucleotide
uuuauaagagaaguuccuc

SEQ ID NO: 3040 - RNA, 19 nt, Artificial Sequence
  Synthetic oligonucleotide
uuauaagagaaguuccucu

SEQ ID NO: 3041 - RNA, 19 nt, Artificial Sequence
  Synthetic oligonucleotide
uauaagagaaguuccucug

SEQ ID NO: 3042 - RNA, 19 nt, Artificial Sequence
  Synthetic oligonucleotide
auaagagaaguuccucuga

SEQ ID NO: 3043 - RNA, 19 nt, Artificial Sequence
  Synthetic oligonucleotide
uaagagaaguuccucugaa

SEQ ID NO: 3044 - RNA, 19 nt, Artificial Sequence
  Synthetic oligonucleotide
aagagaaguuccucugaac

SEQ ID NO: 3045 - RNA, 19 nt, Artificial Sequence
  Synthetic oligonucleotide
agagaaguuccucugaaca

SEQ ID NO: 3046 - RNA, 19 nt, Artificial Sequence
  Synthetic oligonucleotide
gagaaguuccucugaacac

SEQ ID NO: 3047 - RNA, 19 nt, Artificial Sequence
  Synthetic oligonucleotide
agaaguuccucugaacacu

SEQ ID NO: 3048 - RNA, 19 nt, Artificial Sequence
  Synthetic oligonucleotide
gaaguuccucugaacacua

SEQ ID NO: 3049 - RNA, 19 nt, Artificial Sequence
  Synthetic oligonucleotide
aaguuccucugaacacuau

SEQ ID NO: 3050 - RNA, 19 nt, Artificial Sequence
  Synthetic oligonucleotide
aguuccucugaacacuauu

SEQ ID NO: 3051 - RNA, 19 nt, Artificial Sequence
  Synthetic oligonucleotide
guuccucugaacacuauua

SEQ ID NO: 3052 - RNA, 19 nt, Artificial Sequence
  Synthetic oligonucleotide
uuccucugaacacuauuau

SEQ ID NO: 3053 - RNA, 19 nt, Artificial Sequence
  Synthetic oligonucleotide
uccucugaacacuauuauc

SEQ ID NO: 3054 - RNA, 19 nt, Artificial Sequence
  Synthetic oligonucleotide
ccucugaacacuauuaucu

SEQ ID NO: 3055 - RNA, 19 nt, Artificial Sequence
  Synthetic oligonucleotide
ucugaacacuauuaucuuc

SEQ ID NO: 3056 - RNA, 19 nt, Artificial Sequence
  Synthetic oligonucleotide
acacuauuaucuucauggg

SEQ ID NO: 3057 - RNA, 19 nt, Artificial Sequence
  Synthetic oligonucleotide
cagaaguaaaaauaaauac

SEQ ID NO: 3058 - RNA, 19 nt, Artificial Sequence
  Synthetic oligonucleotide
agaaguaaaaauaaauaca

SEQ ID NO: 3059 - RNA, 19 nt, Artificial Sequence
  Synthetic oligonucleotide
uggugagauauaagacaua

SEQ ID NO: 3060 - RNA, 19 nt, Artificial Sequence
  Synthetic oligonucleotide
aagcagcugauggagguuu

SEQ ID NO: 3061 - RNA, 19 nt, Artificial Sequence
  Synthetic oligonucleotide
gauggagguuuuuaaauuu

SEQ ID NO: 3062 - RNA, 19 nt, Artificial Sequence
  Synthetic oligonucleotide
gggaaguugcacugaacac

SEQ ID NO: 3063 - RNA, 19 nt, Artificial Sequence
  Synthetic oligonucleotide
aaguugcacugaacacuau

SEQ ID NO: 3064 - RNA, 19 nt, Artificial Sequence
  Synthetic oligonucleotide
guugcacugaacacuauua

SEQ ID NO: 3065 - RNA, 19 nt, Artificial Sequence
  Synthetic oligonucleotide
acuuugguguuugugaaua

SEQ ID NO: 3066 - RNA, 19 nt, Artificial Sequence
  Synthetic oligonucleotide
ugguguuugugaauagaag

SEQ ID NO: 3067 - RNA, 19 nt, Artificial Sequence
  Synthetic oligonucleotide
gguguuugugaauagaagu

SEQ ID NO: 3068 - RNA, 19 nt, Artificial Sequence
  Synthetic oligonucleotide
guguuugugaauagaagua

SEQ ID NO: 3069 - RNA, 19 nt, Artificial Sequence
  Synthetic oligonucleotide
uguuugugaauagaaguaa

SEQ ID NO: 3070 - RNA, 19 nt, Artificial Sequence
  Synthetic oligonucleotide
ugugaauagaaguaaaaau

SEQ ID NO: 3071 - RNA, 19 nt, Artificial Sequence
  Synthetic oligonucleotide
caagagguaaauauauuac

SEQ ID NO: 3072 - RNA, 19 nt, Artificial Sequence
  Synthetic oligonucleotide
gagaaaugcauuuuuauac

SEQ ID NO: 3073 - RNA, 19 nt, Artificial Sequence
  Synthetic oligonucleotide
ggccauguauuccaaugug

SEQ ID NO: 3074 - RNA, 19 nt, Artificial Sequence
  Synthetic oligonucleotide
gccauguauuccaauguga

SEQ ID NO: 3075 - RNA, 19 nt, Artificial Sequence
  Synthetic oligonucleotide
ccauguauuccaaugugau

SEQ ID NO: 3076 - RNA, 19 nt, Artificial Sequence
  Synthetic oligonucleotide
cauguauuccaaugugaua

SEQ ID NO: 3077 - RNA, 19 nt, Artificial Sequence
  Synthetic oligonucleotide
auguauuccaaugugauag

SEQ ID NO: 3078 - RNA, 19 nt, Artificial Sequence
  Synthetic oligonucleotide
uguauuccaaugugauagg

SEQ ID NO: 3079 - RNA, 19 nt, Artificial Sequence
  Synthetic oligonucleotide
guauuccaaugugauagga

SEQ ID NO: 3080 - RNA, 19 nt, Artificial Sequence
  Synthetic oligonucleotide
accucuggaaaaaggaagg

SEQ ID NO: 3081 - RNA, 19 nt, Artificial Sequence
  Synthetic oligonucleotide
ccucuggaaaaaggaaggu

SEQ ID NO: 3082 - RNA, 19 nt, Artificial Sequence
  Synthetic oligonucleotide
cucuggaaaaaggaagguu

SEQ ID NO: 3083 - RNA, 19 nt, Artificial Sequence
  Synthetic oligonucleotide
cuggaaaaaggaagguuua

SEQ ID NO: 3084 - RNA, 19 nt, Artificial Sequence
  Synthetic oligonucleotide
uggaaaaaggaagguuuau

SEQ ID NO: 3085 - RNA, 19 nt, Artificial Sequence
  Synthetic oligonucleotide
ggaaaaaggaagguuuauc

SEQ ID NO: 3086 - RNA, 19 nt, Artificial Sequence
  Synthetic oligonucleotide
auucccaugaaucccaugu

SEQ ID NO: 3087 - RNA, 19 nt, Artificial Sequence
  Synthetic oligonucleotide
uucccaugaaucccaugug

SEQ ID NO: 3088 - RNA, 19 nt, Artificial Sequence
  Synthetic oligonucleotide
ccaugaaucccaugugcau

SEQ ID NO: 3089 - RNA, 19 nt, Artificial Sequence
  Synthetic oligonucleotide
caugugcauuuaccgcucc

SEQ ID NO: 3090 - RNA, 19 nt, Artificial Sequence
  Synthetic oligonucleotide
gugucugggaacuguccaa

SEQ ID NO: 3091 - RNA, 19 nt, Artificial Sequence
  Synthetic oligonucleotide
ugucugggaacuguccaag

SEQ ID NO: 3092 - RNA, 19 nt, Artificial Sequence
  Synthetic oligonucleotide
gucugggaacuguccaagg

SEQ ID NO: 3093 - RNA, 19 nt, Artificial Sequence
  Synthetic oligonucleotide
ucugggaacuguccaaggc

SEQ ID NO: 3094 - RNA, 19 nt, Artificial Sequence
  Synthetic oligonucleotide
cugggaacuguccaaggcc

SEQ ID NO: 3095 - RNA, 19 nt, Artificial Sequence
  Synthetic oligonucleotide
ugggaacuguccaaggcca

SEQ ID NO: 3096 - RNA, 19 nt, Artificial Sequence
  Synthetic oligonucleotide
gggaacuguccaaggccaa

SEQ ID NO: 3097 - RNA, 19 nt, Artificial Sequence
  Synthetic oligonucleotide
ggaacuguccaaggccaau

SEQ ID NO: 3098 - RNA, 19 nt, Artificial Sequence
  Synthetic oligonucleotide
caauucccgcuuugcuacc

SEQ ID NO: 3099 - RNA, 19 nt, Artificial Sequence
  Synthetic oligonucleotide
uucccgcuuugcuaccacu

SEQ ID NO: 3100 - RNA, 19 nt, Artificial Sequence
  Synthetic oligonucleotide
ucccgcuuugcuaccacuu

SEQ ID NO: 3101 - RNA, 19 nt, Artificial Sequence
  Synthetic oligonucleotide
cccgcuuugcuaccacuuu

SEQ ID NO: 3102 - RNA, 19 nt, Artificial Sequence
  Synthetic oligonucleotide
ccgcuuugcuaccacuuuc

SEQ ID NO: 3103 - RNA, 19 nt, Artificial Sequence
  Synthetic oligonucleotide
cgcuuugcuaccacuuucu

SEQ ID NO: 3104 - RNA, 19 nt, Artificial Sequence
  Synthetic oligonucleotide
gcuuugcuaccacuuucua

SEQ ID NO: 3105 - RNA, 19 nt, Artificial Sequence
  Synthetic oligonucleotide
cuuugcuaccacuuucuau

SEQ ID NO: 3106 - RNA, 19 nt, Artificial Sequence
  Synthetic oligonucleotide
uuugcuaccacuuucuauc

SEQ ID NO: 3107 - RNA, 19 nt, Artificial Sequence
  Synthetic oligonucleotide
uugcuaccacuuucuauca

SEQ ID NO: 3108 - RNA, 19 nt, Artificial Sequence
  Synthetic oligonucleotide
gcaccuggcagauuccaag

SEQ ID NO: 3109 - RNA, 19 nt, Artificial Sequence
  Synthetic oligonucleotide
augauaacauuuuccuguc

SEQ ID NO: 3110 - RNA, 19 nt, Artificial Sequence
  Synthetic oligonucleotide
auaacauuuuccugucacc

SEQ ID NO: 3111 - RNA, 19 nt, Artificial Sequence
  Synthetic oligonucleotide
aacauuuuccugucacccc

SEQ ID NO: 3112 - RNA, 19 nt, Artificial Sequence
  Synthetic oligonucleotide
cggcuuuugcuaugaccaa

SEQ ID NO: 3113 - RNA, 19 nt, Artificial Sequence
  Synthetic oligonucleotide
ggcuuuugcuaugaccaag

SEQ ID NO: 3114 - RNA, 19 nt, Artificial Sequence
  Synthetic oligonucleotide
gcuuuugcuaugaccaagc

SEQ ID NO: 3115 - RNA, 19 nt, Artificial Sequence
  Synthetic oligonucleotide
cuuuugcuaugaccaagcu

SEQ ID NO: 3116 - RNA, 19 nt, Artificial Sequence
  Synthetic oligonucleotide
uuuugcuaugaccaagcug

SEQ ID NO: 3117 - RNA, 19 nt, Artificial Sequence
  Synthetic oligonucleotide
uuugcuaugaccaagcugg

SEQ ID NO: 3118 - RNA, 19 nt, Artificial Sequence
  Synthetic oligonucleotide
uugcuaugaccaagcuggg

SEQ ID NO: 3119 - RNA, 19 nt, Artificial Sequence
  Synthetic oligonucleotide
ugcuaugaccaagcugggu

SEQ ID NO: 3120 - RNA, 19 nt, Artificial Sequence
  Synthetic oligonucleotide
gcuaugaccaagcugggug

SEQ ID NO: 3121 - RNA, 19 nt, Artificial Sequence
  Synthetic oligonucleotide
cuaugaccaagcugggugc

SEQ ID NO: 3122 - RNA, 19 nt, Artificial Sequence
  Synthetic oligonucleotide
uaugaccaagcugggugcc

SEQ ID NO: 3123 - RNA, 19 nt, Artificial Sequence
  Synthetic oligonucleotide
augaccaagcugggugccu

SEQ ID NO: 3124 - RNA, 19 nt, Artificial Sequence
  Synthetic oligonucleotide
ugaccaagcugggugccug

SEQ ID NO: 3125 - RNA, 19 nt, Artificial Sequence
  Synthetic oligonucleotide
gaccaagcugggugccugu

SEQ ID NO: 3126 - RNA, 19 nt, Artificial Sequence
  Synthetic oligonucleotide
ccagcaacugauggaggua

SEQ ID NO: 3127 - RNA, 19 nt, Artificial Sequence
  Synthetic oligonucleotide
cagcaacugauggagguau

SEQ ID NO: 3128 - RNA, 19 nt, Artificial Sequence
  Synthetic oligonucleotide
agcaacugauggagguauu

SEQ ID NO: 3129 - RNA, 19 nt, Artificial Sequence
  Synthetic oligonucleotide
gcaacugauggagguauuu

SEQ ID NO: 3130 - RNA, 19 nt, Artificial Sequence
  Synthetic oligonucleotide
caacugauggagguauuua

SEQ ID NO: 3131 - RNA, 19 nt, Artificial Sequence
  Synthetic oligonucleotide
aacugauggagguauuuaa

SEQ ID NO: 3132 - RNA, 19 nt, Artificial Sequence
  Synthetic oligonucleotide
acugauggagguauuuaag

SEQ ID NO: 3133 - RNA, 19 nt, Artificial Sequence
  Synthetic oligonucleotide
cugauggagguauuuaagu

SEQ ID NO: 3134 - RNA, 19 nt, Artificial Sequence
  Synthetic oligonucleotide
ugauggagguauuuaaguu

SEQ ID NO: 3135 - RNA, 19 nt, Artificial Sequence
  Synthetic oligonucleotide
gauggagguauuuaaguuu

SEQ ID NO: 3136 - RNA, 19 nt, Artificial Sequence
  Synthetic oligonucleotide
auggagguauuuaaguuug

SEQ ID NO: 3137 - RNA, 19 nt, Artificial Sequence
  Synthetic oligonucleotide
uggagguauuuaaguuuga

SEQ ID NO: 3138 - RNA, 19 nt, Artificial Sequence
  Synthetic oligonucleotide
ggagguauuuaaguuugac

SEQ ID NO: 3139 - RNA, 19 nt, Artificial Sequence
  Synthetic oligonucleotide
gagguauuuaaguuugaca

SEQ ID NO: 3140 - RNA, 19 nt, Artificial Sequence
  Synthetic oligonucleotide
agguauuuaaguuugacac

SEQ ID NO: 3141 - RNA, 19 nt, Artificial Sequence
  Synthetic oligonucleotide
gguauuuaaguuugacacc

SEQ ID NO: 3142 - RNA, 19 nt, Artificial Sequence
  Synthetic oligonucleotide
guauuuaaguuugacacca

SEQ ID NO: 3143 - RNA, 19 nt, Artificial Sequence
  Synthetic oligonucleotide
uauuuaaguuugacaccau

SEQ ID NO: 3144 - RNA, 19 nt, Artificial Sequence
  Synthetic oligonucleotide
auuuaaguuugacaccaua

SEQ ID NO: 3145 - RNA, 19 nt, Artificial Sequence
  Synthetic oligonucleotide
uuuaaguuugacaccauau

SEQ ID NO: 3146 - RNA, 19 nt, Artificial Sequence
  Synthetic oligonucleotide
uuaaguuugacaccauauc

SEQ ID NO: 3147 - RNA, 19 nt, Artificial Sequence
  Synthetic oligonucleotide
uaaguuugacaccauaucu

SEQ ID NO: 3148 - RNA, 19 nt, Artificial Sequence
  Synthetic oligonucleotide
aaguuugacaccauaucug

SEQ ID NO: 3149 - RNA, 19 nt, Artificial Sequence
  Synthetic oligonucleotide
aguuugacaccauaucuga

SEQ ID NO: 3150 - RNA, 19 nt, Artificial Sequence
  Synthetic oligonucleotide
guuugacaccauaucugag

SEQ ID NO: 3151 - RNA, 19 nt, Artificial Sequence
  Synthetic oligonucleotide
uuugacaccauaucugaga

SEQ ID NO: 3152 - RNA, 19 nt, Artificial Sequence
  Synthetic oligonucleotide
uugacaccauaucugagaa

SEQ ID NO: 3153 - RNA, 19 nt, Artificial Sequence
  Synthetic oligonucleotide
ugacaccauaucugagaaa

SEQ ID NO: 3154 - RNA, 19 nt, Artificial Sequence
  Synthetic oligonucleotide
gacaccauaucugagaaaa

SEQ ID NO: 3155 - RNA, 19 nt, Artificial Sequence
  Synthetic oligonucleotide
acaccauaucugagaaaac

SEQ ID NO: 3156 - RNA, 19 nt, Artificial Sequence
  Synthetic oligonucleotide
caccauaucugagaaaaca

SEQ ID NO: 3157 - RNA, 19 nt, Artificial Sequence
  Synthetic oligonucleotide
accauaucugagaaaacau

SEQ ID NO: 3158 - RNA, 19 nt, Artificial Sequence
  Synthetic oligonucleotide
ccauaucugagaaaacauc

SEQ ID NO: 3159 - RNA, 19 nt, Artificial Sequence
  Synthetic oligonucleotide
cauaucugagaaaacaucu

SEQ ID NO: 3160 - RNA, 19 nt, Artificial Sequence
  Synthetic oligonucleotide
aucugagaaaacaucugau

SEQ ID NO: 3161 - RNA, 19 nt, Artificial Sequence
  Synthetic oligonucleotide
ucugagaaaacaucugauc

SEQ ID NO: 3162 - RNA, 19 nt, Artificial Sequence
  Synthetic oligonucleotide
cugagaaaacaucugauca

SEQ ID NO: 3163 - RNA, 19 nt, Artificial Sequence
  Synthetic oligonucleotide
ugagaaaacaucugaucag

SEQ ID NO: 3164 - RNA, 19 nt, Artificial Sequence
  Synthetic oligonucleotide
ugaucagauccacuucuuc

SEQ ID NO: 3165 - RNA, 19 nt, Artificial Sequence
  Synthetic oligonucleotide
aucagauccacuucuucuu

SEQ ID NO: 3166 - RNA, 19 nt, Artificial Sequence
  Synthetic oligonucleotide
ucagauccacuucuucuuu

SEQ ID NO: 3167 - RNA, 19 nt, Artificial Sequence
  Synthetic oligonucleotide
cagauccacuucuucuuug

SEQ ID NO: 3168 - RNA, 19 nt, Artificial Sequence
  Synthetic oligonucleotide
agauccacuucuucuuugc

SEQ ID NO: 3169 - RNA, 19 nt, Artificial Sequence
  Synthetic oligonucleotide
gauccacuucuucuuugcc

SEQ ID NO: 3170 - RNA, 19 nt, Artificial Sequence
  Synthetic oligonucleotide
auccacuucuucuuugcca

SEQ ID NO: 3171 - RNA, 19 nt, Artificial Sequence
  Synthetic oligonucleotide
uccacuucuucuuugccaa

SEQ ID NO: 3172 - RNA, 19 nt, Artificial Sequence
  Synthetic oligonucleotide
ccacuucuucuuugccaaa

SEQ ID NO: 3173 - RNA, 19 nt, Artificial Sequence
  Synthetic oligonucleotide
cacuucuucuuugccaaac

SEQ ID NO: 3174 - RNA, 19 nt, Artificial Sequence
  Synthetic oligonucleotide
acuucuucuuugccaaacu

SEQ ID NO: 3175 - RNA, 19 nt, Artificial Sequence
  Synthetic oligonucleotide
cuucuucuuugccaaacug

SEQ ID NO: 3176 - RNA, 19 nt, Artificial Sequence
  Synthetic oligonucleotide
uucuucuuugccaaacuga

SEQ ID NO: 3177 - RNA, 19 nt, Artificial Sequence
  Synthetic oligonucleotide
ucuucuuugccaaacugaa

SEQ ID NO: 3178 - RNA, 19 nt, Artificial Sequence
  Synthetic oligonucleotide
cuucuuugccaaacugaac

SEQ ID NO: 3179 - RNA, 19 nt, Artificial Sequence
  Synthetic oligonucleotide
uucuuugccaaacugaacu

SEQ ID NO: 3180 - RNA, 19 nt, Artificial Sequence
  Synthetic oligonucleotide
ucuuugccaaacugaacug

SEQ ID NO: 3181 - RNA, 19 nt, Artificial Sequence
  Synthetic oligonucleotide
cuuugccaaacugaacugc

SEQ ID NO: 3182 - RNA, 19 nt, Artificial Sequence
  Synthetic oligonucleotide
uuugccaaacugaacugcc

SEQ ID NO: 3183 - RNA, 19 nt, Artificial Sequence
  Synthetic oligonucleotide
uugccaaacugaacugccg

SEQ ID NO: 3184 - RNA, 19 nt, Artificial Sequence
  Synthetic oligonucleotide
ugccaaacugaacugccga

SEQ ID NO: 3185 - RNA, 19 nt, Artificial Sequence
  Synthetic oligonucleotide
gccaaacugaacugccgac

SEQ ID NO: 3186 - RNA, 19 nt, Artificial Sequence
  Synthetic oligonucleotide
ccaaacugaacugccgacu

SEQ ID NO: 3187 - RNA, 19 nt, Artificial Sequence
  Synthetic oligonucleotide
caaacugaacugccgacuc

SEQ ID NO: 3188 - RNA, 19 nt, Artificial Sequence
  Synthetic oligonucleotide
aaacugaacugccgacucu

SEQ ID NO: 3189 - RNA, 19 nt, Artificial Sequence
  Synthetic oligonucleotide
aacugaacugccgacucua

SEQ ID NO: 3190 - RNA, 19 nt, Artificial Sequence
  Synthetic oligonucleotide
acugaacugccgacucuau

SEQ ID NO: 3191 - RNA, 19 nt, Artificial Sequence
  Synthetic oligonucleotide
cugaacugccgacucuauc

SEQ ID NO: 3192 - RNA, 19 nt, Artificial Sequence
  Synthetic oligonucleotide
ugaacugccgacucuaucg

SEQ ID NO: 3193 - RNA, 19 nt, Artificial Sequence
  Synthetic oligonucleotide
gaacugccgacucuaucga

SEQ ID NO: 3194 - RNA, 19 nt, Artificial Sequence
  Synthetic oligonucleotide
aacugccgacucuaucgaa

SEQ ID NO: 3195 - RNA, 19 nt, Artificial Sequence
  Synthetic oligonucleotide
acugccgacucuaucgaaa

SEQ ID NO: 3196 - RNA, 19 nt, Artificial Sequence
  Synthetic oligonucleotide
cugccgacucuaucgaaaa

SEQ ID NO: 3197 - RNA, 19 nt, Artificial Sequence
  Synthetic oligonucleotide
ugccgacucuaucgaaaag

SEQ ID NO: 3198 - RNA, 19 nt, Artificial Sequence
  Synthetic oligonucleotide
gccgacucuaucgaaaagc

SEQ ID NO: 3199 - RNA, 19 nt, Artificial Sequence
  Synthetic oligonucleotide
ccgacucuaucgaaaagcc

SEQ ID NO: 3200 - RNA, 19 nt, Artificial Sequence
  Synthetic oligonucleotide
cgacucuaucgaaaagcca

SEQ ID NO: 3201 - RNA, 19 nt, Artificial Sequence
  Synthetic oligonucleotide
gacucuaucgaaaagccaa

SEQ ID NO: 3202 - RNA, 19 nt, Artificial Sequence
  Synthetic oligonucleotide
acucuaucgaaaagccaac

SEQ ID NO: 3203 - RNA, 19 nt, Artificial Sequence
  Synthetic oligonucleotide
cgaaaagccaacaaauccu

SEQ ID NO: 3204 - RNA, 19 nt, Artificial Sequence
  Synthetic oligonucleotide
gaaaagccaacaaauccuc

SEQ ID NO: 3205 - RNA, 19 nt, Artificial Sequence
  Synthetic oligonucleotide
aagccaacaaauccuccaa

SEQ ID NO: 3206 - RNA, 19 nt, Artificial Sequence
  Synthetic oligonucleotide
agccaacaaauccuccaag

SEQ ID NO: 3207 - RNA, 19 nt, Artificial Sequence
  Synthetic oligonucleotide
gccaacaaauccuccaagu

SEQ ID NO: 3208 - RNA, 19 nt, Artificial Sequence
  Synthetic oligonucleotide
ccaacaaauccuccaaguu

SEQ ID NO: 3209 - RNA, 19 nt, Artificial Sequence
  Synthetic oligonucleotide
caacaaauccuccaaguua

SEQ ID NO: 3210 - RNA, 19 nt, Artificial Sequence
  Synthetic oligonucleotide
aacaaauccuccaaguuag

SEQ ID NO: 3211 - RNA, 19 nt, Artificial Sequence
  Synthetic oligonucleotide
caaguuaguaucagccaau

SEQ ID NO: 3212 - RNA, 19 nt, Artificial Sequence
  Synthetic oligonucleotide
uuaguaucagccaaucgcc

SEQ ID NO: 3213 - RNA, 19 nt, Artificial Sequence
  Synthetic oligonucleotide
aucagccaaucgccuuuuu

SEQ ID NO: 3214 - RNA, 19 nt, Artificial Sequence
  Synthetic oligonucleotide
ucagccaaucgccuuuuug

SEQ ID NO: 3215 - RNA, 19 nt, Artificial Sequence
  Synthetic oligonucleotide
cagccaaucgccuuuuugg

SEQ ID NO: 3216 - RNA, 19 nt, Artificial Sequence
  Synthetic oligonucleotide
caaucgccuuuuuggagac

SEQ ID NO: 3217 - RNA, 19 nt, Artificial Sequence
  Synthetic oligonucleotide
aucgccuuuuuggagacaa

SEQ ID NO: 3218 - RNA, 19 nt, Artificial Sequence
  Synthetic oligonucleotide
ucgccuuuuuggagacaaa

SEQ ID NO: 3219 - RNA, 19 nt, Artificial Sequence
  Synthetic oligonucleotide
cgccuuuuuggagacaaau

SEQ ID NO: 3220 - RNA, 19 nt, Artificial Sequence
  Synthetic oligonucleotide
gccuuuuuggagacaaauc

SEQ ID NO: 3221 - RNA, 19 nt, Artificial Sequence
  Synthetic oligonucleotide
ccuuuuuggagacaaaucc

SEQ ID NO: 3222 - RNA, 19 nt, Artificial Sequence
  Synthetic oligonucleotide
uuuggagacaaaucccuua

SEQ ID NO: 3223 - RNA, 19 nt, Artificial Sequence
  Synthetic oligonucleotide
uuggagacaaaucccuuac

SEQ ID NO: 3224 - RNA, 19 nt, Artificial Sequence
  Synthetic oligonucleotide
uggagacaaaucccuuacc

SEQ ID NO: 3225 - RNA, 19 nt, Artificial Sequence
  Synthetic oligonucleotide
ggagacaaaucccuuaccu

SEQ ID NO: 3226 - RNA, 19 nt, Artificial Sequence
  Synthetic oligonucleotide
gagacaaaucccuuaccuu

SEQ ID NO: 3227 - RNA, 19 nt, Artificial Sequence
  Synthetic oligonucleotide
agacaaaucccuuaccuuc

SEQ ID NO: 3228 - RNA, 19 nt, Artificial Sequence
  Synthetic oligonucleotide
acaaaucccuuaccuucaa

SEQ ID NO: 3229 - RNA, 19 nt, Artificial Sequence
  Synthetic oligonucleotide
caaaucccuuaccuucaau

SEQ ID NO: 3230 - RNA, 19 nt, Artificial Sequence
  Synthetic oligonucleotide
aaaucccuuaccuucaaug

SEQ ID NO: 3231 - RNA, 19 nt, Artificial Sequence
  Synthetic oligonucleotide
uuaccuucaaugagaccua

SEQ ID NO: 3232 - RNA, 19 nt, Artificial Sequence
  Synthetic oligonucleotide
cuucaaugagaccuaccag

SEQ ID NO: 3233 - RNA, 19 nt, Artificial Sequence
  Synthetic oligonucleotide
uucaaugagaccuaccagg

SEQ ID NO: 3234 - RNA, 19 nt, Artificial Sequence
  Synthetic oligonucleotide
ucaaugagaccuaccagga

SEQ ID NO: 3235 - RNA, 19 nt, Artificial Sequence
  Synthetic oligonucleotide
aaugagaccuaccaggaca

SEQ ID NO: 3236 - RNA, 19 nt, Artificial Sequence
  Synthetic oligonucleotide
ugagaccuaccaggacauc

SEQ ID NO: 3237 - RNA, 19 nt, Artificial Sequence
  Synthetic oligonucleotide
accuaccaggacaucagug

SEQ ID NO: 3238 - RNA, 19 nt, Artificial Sequence
  Synthetic oligonucleotide
ccuaccaggacaucaguga

SEQ ID NO: 3239 - RNA, 19 nt, Artificial Sequence
  Synthetic oligonucleotide
cuaccaggacaucagugag

SEQ ID NO: 3240 - RNA, 19 nt, Artificial Sequence
  Synthetic oligonucleotide
uaccaggacaucagugagu

SEQ ID NO: 3241 - RNA, 19 nt, Artificial Sequence
  Synthetic oligonucleotide
accaggacaucagugaguu

SEQ ID NO: 3242 - RNA, 19 nt, Artificial Sequence
  Synthetic oligonucleotide
ccaggacaucagugaguug

SEQ ID NO: 3243 - RNA, 19 nt, Artificial Sequence
  Synthetic oligonucleotide
caggacaucagugaguugg

SEQ ID NO: 3244 - RNA, 19 nt, Artificial Sequence
  Synthetic oligonucleotide
aggacaucagugaguuggu

SEQ ID NO: 3245 - RNA, 19 nt, Artificial Sequence
  Synthetic oligonucleotide
ggacaucagugaguuggua

SEQ ID NO: 3246 - RNA, 19 nt, Artificial Sequence
  Synthetic oligonucleotide
uauauggagccaagcucca

SEQ ID NO: 3247 - RNA, 19 nt, Artificial Sequence
  Synthetic oligonucleotide
auauggagccaagcuccag

SEQ ID NO: 3248 - RNA, 19 nt, Artificial Sequence
  Synthetic oligonucleotide
uauggagccaagcuccagc

SEQ ID NO: 3249 - RNA, 19 nt, Artificial Sequence
  Synthetic oligonucleotide
auggagccaagcuccagcc

SEQ ID NO: 3250 - RNA, 19 nt, Artificial Sequence
  Synthetic oligonucleotide
uggagccaagcuccagccc

SEQ ID NO: 3251 - RNA, 19 nt, Artificial Sequence
  Synthetic oligonucleotide
ggagccaagcuccagcccc

SEQ ID NO: 3252 - RNA, 19 nt, Artificial Sequence
  Synthetic oligonucleotide
gagccaagcuccagccccu

SEQ ID NO: 3253 - RNA, 19 nt, Artificial Sequence
  Synthetic oligonucleotide
agccaagcuccagccccug

SEQ ID NO: 3254 - RNA, 19 nt, Artificial Sequence
  Synthetic oligonucleotide
gccaagcuccagccccugg

SEQ ID NO: 3255 - RNA, 19 nt, Artificial Sequence
  Synthetic oligonucleotide
ccaagcuccagccccugga

SEQ ID NO: 3256 - RNA, 19 nt, Artificial Sequence
  Synthetic oligonucleotide
caagcuccagccccuggac

SEQ ID NO: 3257 - RNA, 19 nt, Artificial Sequence
  Synthetic oligonucleotide
aagcuccagccccuggacu

SEQ ID NO: 3258 - RNA, 19 nt, Artificial Sequence
  Synthetic oligonucleotide
agcuccagccccuggacuu

SEQ ID NO: 3259 - RNA, 19 nt, Artificial Sequence
  Synthetic oligonucleotide
gcuccagccccuggacuuc

SEQ ID NO: 3260 - RNA, 19 nt, Artificial Sequence
  Synthetic oligonucleotide
cuccagccccuggacuuca

SEQ ID NO: 3261 - RNA, 19 nt, Artificial Sequence
  Synthetic oligonucleotide
uccagccccuggacuucaa

SEQ ID NO: 3262 - RNA, 19 nt, Artificial Sequence
  Synthetic oligonucleotide
ccagccccuggacuucaag

SEQ ID NO: 3263 - RNA, 19 nt, Artificial Sequence
  Synthetic oligonucleotide
cagccccuggacuucaagg

SEQ ID NO: 3264 - RNA, 19 nt, Artificial Sequence
  Synthetic oligonucleotide
ccuggacuucaaggaaaau

SEQ ID NO: 3265 - RNA, 19 nt, Artificial Sequence
  Synthetic oligonucleotide
cuggacuucaaggaaaaug

SEQ ID NO: 3266 - RNA, 19 nt, Artificial Sequence
  Synthetic oligonucleotide
uggacuucaaggaaaaugc

SEQ ID NO: 3267 - RNA, 19 nt, Artificial Sequence
  Synthetic oligonucleotide
ggacuucaaggaaaaugca

SEQ ID NO: 3268 - RNA, 19 nt, Artificial Sequence
  Synthetic oligonucleotide
acuucaaggaaaaugcaga

SEQ ID NO: 3269 - RNA, 19 nt, Artificial Sequence
  Synthetic oligonucleotide
cuucaaggaaaaugcagag

SEQ ID NO: 3270 - RNA, 19 nt, Artificial Sequence
  Synthetic oligonucleotide
uucaaggaaaaugcagagc

SEQ ID NO: 3271 - RNA, 19 nt, Artificial Sequence
  Synthetic oligonucleotide
ucaaggaaaaugcagagca

SEQ ID NO: 3272 - RNA, 19 nt, Artificial Sequence
  Synthetic oligonucleotide
gccaucaacaaaugggugu

SEQ ID NO: 3273 - RNA, 19 nt, Artificial Sequence
  Synthetic oligonucleotide
ccaucaacaaauggguguc

SEQ ID NO: 3274 - RNA, 19 nt, Artificial Sequence
  Synthetic oligonucleotide
aacaaauggguguccaaua

SEQ ID NO: 3275 - RNA, 19 nt, Artificial Sequence
  Synthetic oligonucleotide
augagcucacuguucuggu

SEQ ID NO: 3276 - RNA, 19 nt, Artificial Sequence
  Synthetic oligonucleotide
gagcucacuguucuggugc

SEQ ID NO: 3277 - RNA, 19 nt, Artificial Sequence
  Synthetic oligonucleotide
agcucacuguucuggugcu

SEQ ID NO: 3278 - RNA, 19 nt, Artificial Sequence
  Synthetic oligonucleotide
gcucacuguucuggugcug

SEQ ID NO: 3279 - RNA, 19 nt, Artificial Sequence
  Synthetic oligonucleotide
cucacuguucuggugcugg

SEQ ID NO: 3280 - RNA, 19 nt, Artificial Sequence
  Synthetic oligonucleotide
ucacuguucuggugcuggu

SEQ ID NO: 3281 - RNA, 19 nt, Artificial Sequence
  Synthetic oligonucleotide
cacuguucuggugcugguu

SEQ ID NO: 3282 - RNA, 19 nt, Artificial Sequence
  Synthetic oligonucleotide
acuguucuggugcugguua

SEQ ID NO: 3283 - RNA, 19 nt, Artificial Sequence
  Synthetic oligonucleotide
cuguucuggugcugguuaa

SEQ ID NO: 3284 - RNA, 19 nt, Artificial Sequence
  Synthetic oligonucleotide
uguucuggugcugguuaac

SEQ ID NO: 3285 - RNA, 19 nt, Artificial Sequence
  Synthetic oligonucleotide
guucuggugcugguuaaca

SEQ ID NO: 3286 - RNA, 19 nt, Artificial Sequence
  Synthetic oligonucleotide
uucuggugcugguuaacac

SEQ ID NO: 3287 - RNA, 19 nt, Artificial Sequence
  Synthetic oligonucleotide
ucuggugcugguuaacacc

SEQ ID NO: 3288 - RNA, 19 nt, Artificial Sequence
  Synthetic oligonucleotide
cuggugcugguuaacacca

SEQ ID NO: 3289 - RNA, 19 nt, Artificial Sequence
  Synthetic oligonucleotide
uggugcugguuaacaccau

SEQ ID NO: 3290 - RNA, 19 nt, Artificial Sequence
  Synthetic oligonucleotide
ggugcugguuaacaccauu

SEQ ID NO: 3291 - RNA, 19 nt, Artificial Sequence
  Synthetic oligonucleotide
gugcugguuaacaccauuu

SEQ ID NO: 3292 - RNA, 19 nt, Artificial Sequence
  Synthetic oligonucleotide
ugcugguuaacaccauuua

SEQ ID NO: 3293 - RNA, 19 nt, Artificial Sequence
  Synthetic oligonucleotide
gcugguuaacaccauuuac

SEQ ID NO: 3294 - RNA, 19 nt, Artificial Sequence
  Synthetic oligonucleotide
cugguuaacaccauuuacu

SEQ ID NO: 3295 - RNA, 19 nt, Artificial Sequence
  Synthetic oligonucleotide
ugguuaacaccauuuacuu

SEQ ID NO: 3296 - RNA, 19 nt, Artificial Sequence
  Synthetic oligonucleotide
gguuaacaccauuuacuuc

SEQ ID NO: 3297 - RNA, 19 nt, Artificial Sequence
  Synthetic oligonucleotide
guuaacaccauuuacuuca

SEQ ID NO: 3298 - RNA, 19 nt, Artificial Sequence
  Synthetic oligonucleotide
uuaacaccauuuacuucaa

SEQ ID NO: 3299 - RNA, 19 nt, Artificial Sequence
  Synthetic oligonucleotide
uaacaccauuuacuucaag

SEQ ID NO: 3300 - RNA, 19 nt, Artificial Sequence
  Synthetic oligonucleotide
aacaccauuuacuucaagg

SEQ ID NO: 3301 - RNA, 19 nt, Artificial Sequence
  Synthetic oligonucleotide
acaccauuuacuucaaggg

SEQ ID NO: 3302 - RNA, 19 nt, Artificial Sequence
  Synthetic oligonucleotide
caccauuuacuucaagggc

SEQ ID NO: 3303 - RNA, 19 nt, Artificial Sequence
  Synthetic oligonucleotide
accauuuacuucaagggcc

SEQ ID NO: 3304 - RNA, 19 nt, Artificial Sequence
  Synthetic oligonucleotide
ccauuuacuucaagggccu

SEQ ID NO: 3305 - RNA, 19 nt, Artificial Sequence
  Synthetic oligonucleotide
cauuuacuucaagggccug

SEQ ID NO: 3306 - RNA, 19 nt, Artificial Sequence
  Synthetic oligonucleotide
auuuacuucaagggccugu

SEQ ID NO: 3307 - RNA, 19 nt, Artificial Sequence
  Synthetic oligonucleotide
uuuacuucaagggccugug

SEQ ID NO: 3308 - RNA, 19 nt, Artificial Sequence
  Synthetic oligonucleotide
uuacuucaagggccugugg

SEQ ID NO: 3309 - RNA, 19 nt, Artificial Sequence
  Synthetic oligonucleotide
uacuucaagggccugugga

SEQ ID NO: 3310 - RNA, 19 nt, Artificial Sequence
  Synthetic oligonucleotide
acuucaagggccuguggaa

SEQ ID NO: 3311 - RNA, 19 nt, Artificial Sequence
  Synthetic oligonucleotide
cuucaagggccuguggaag

SEQ ID NO: 3312 - RNA, 19 nt, Artificial Sequence
  Synthetic oligonucleotide
uucaagggccuguggaagu

SEQ ID NO: 3313 - RNA, 19 nt, Artificial Sequence
  Synthetic oligonucleotide
ucaagggccuguggaaguc

SEQ ID NO: 3314 - RNA, 19 nt, Artificial Sequence
  Synthetic oligonucleotide
caagggccuguggaaguca

SEQ ID NO: 3315 - RNA, 19 nt, Artificial Sequence
  Synthetic oligonucleotide
aagggccuguggaagucaa

SEQ ID NO: 3316 - RNA, 19 nt, Artificial Sequence
  Synthetic oligonucleotide
agggccuguggaagucaaa

SEQ ID NO: 3317 - RNA, 19 nt, Artificial Sequence
  Synthetic oligonucleotide
gggccuguggaagucaaag

SEQ ID NO: 3318 - RNA, 19 nt, Artificial Sequence
  Synthetic oligonucleotide
ggccuguggaagucaaagu

SEQ ID NO: 3319 - RNA, 19 nt, Artificial Sequence
  Synthetic oligonucleotide
gccuguggaagucaaaguu

SEQ ID NO: 3320 - RNA, 19 nt, Artificial Sequence
  Synthetic oligonucleotide
ccuguggaagucaaaguuc

SEQ ID NO: 3321 - RNA, 19 nt, Artificial Sequence
  Synthetic oligonucleotide
cuguggaagucaaaguuca

SEQ ID NO: 3322 - RNA, 19 nt, Artificial Sequence
  Synthetic oligonucleotide
uguggaagucaaaguucag

SEQ ID NO: 3323 - RNA, 19 nt, Artificial Sequence
  Synthetic oligonucleotide
guggaagucaaaguucagc

SEQ ID NO: 3324 - RNA, 19 nt, Artificial Sequence
  Synthetic oligonucleotide
uggaagucaaaguucagcc

SEQ ID NO: 3325 - RNA, 19 nt, Artificial Sequence
  Synthetic oligonucleotide
ggaagucaaaguucagccc

SEQ ID NO: 3326 - RNA, 19 nt, Artificial Sequence
  Synthetic oligonucleotide
gaagucaaaguucagcccu

SEQ ID NO: 3327 - RNA, 19 nt, Artificial Sequence
  Synthetic oligonucleotide
uacaaggcugauggagagu

SEQ ID NO: 3328 - RNA, 19 nt, Artificial Sequence
  Synthetic oligonucleotide
cugauggagagucguguuc

SEQ ID NO: 3329 - RNA, 19 nt, Artificial Sequence
  Synthetic oligonucleotide
ugauggagagucguguuca

SEQ ID NO: 3330 - RNA, 19 nt, Artificial Sequence
  Synthetic oligonucleotide
aucuaugauguaccaggaa

SEQ ID NO: 3331 - RNA, 19 nt, Artificial Sequence
  Synthetic oligonucleotide
ucuaugauguaccaggaag

SEQ ID NO: 3332 - RNA, 19 nt, Artificial Sequence
  Synthetic oligonucleotide
cuaugauguaccaggaagg

SEQ ID NO: 3333 - RNA, 19 nt, Artificial Sequence
  Synthetic oligonucleotide
uaugauguaccaggaaggc

SEQ ID NO: 3334 - RNA, 19 nt, Artificial Sequence
  Synthetic oligonucleotide
ugauguaccaggaaggcaa

SEQ ID NO: 3335 - RNA, 19 nt, Artificial Sequence
  Synthetic oligonucleotide
acccaggugcuugaguugc

SEQ ID NO: 3336 - RNA, 19 nt, Artificial Sequence
  Synthetic oligonucleotide
caggugcuugaguugcccu

SEQ ID NO: 3337 - RNA, 19 nt, Artificial Sequence
  Synthetic oligonucleotide
aggugcuugaguugcccuu

SEQ ID NO: 3338 - RNA, 19 nt, Artificial Sequence
  Synthetic oligonucleotide
ggugcuugaguugcccuuc

SEQ ID NO: 3339 - RNA, 19 nt, Artificial Sequence
  Synthetic oligonucleotide
aaggugaugacaucaccau

SEQ ID NO: 3340 - RNA, 19 nt, Artificial Sequence
  Synthetic oligonucleotide
aggugaugacaucaccaug

SEQ ID NO: 3341 - RNA, 19 nt, Artificial Sequence
  Synthetic oligonucleotide
cuugcccaagccugagaag

SEQ ID NO: 3342 - RNA, 19 nt, Artificial Sequence
  Synthetic oligonucleotide
uugcccaagccugagaaga

SEQ ID NO: 3343 - RNA, 19 nt, Artificial Sequence
  Synthetic oligonucleotide
ugcccaagccugagaagag

SEQ ID NO: 3344 - RNA, 19 nt, Artificial Sequence
  Synthetic oligonucleotide
gcccaagccugagaagagc

SEQ ID NO: 3345 - RNA, 19 nt, Artificial Sequence
  Synthetic oligonucleotide
cccaagccugagaagagcc

SEQ ID NO: 3346 - RNA, 19 nt, Artificial Sequence
  Synthetic oligonucleotide
ccaagccugagaagagccu

SEQ ID NO: 3347 - RNA, 19 nt, Artificial Sequence
  Synthetic oligonucleotide
caagccugagaagagccug

SEQ ID NO: 3348 - RNA, 19 nt, Artificial Sequence
  Synthetic oligonucleotide
aagccugagaagagccugg

SEQ ID NO: 3349 - RNA, 19 nt, Artificial Sequence
  Synthetic oligonucleotide
agccugagaagagccuggc

SEQ ID NO: 3350 - RNA, 19 nt, Artificial Sequence
  Synthetic oligonucleotide
gccugagaagagccuggcc

SEQ ID NO: 3351 - RNA, 19 nt, Artificial Sequence
  Synthetic oligonucleotide
ccugagaagagccuggcca

SEQ ID NO: 3352 - RNA, 19 nt, Artificial Sequence
  Synthetic oligonucleotide
cugagaagagccuggccaa

SEQ ID NO: 3353 - RNA, 19 nt, Artificial Sequence
  Synthetic oligonucleotide
ugagaagagccuggccaag

SEQ ID NO: 3354 - RNA, 19 nt, Artificial Sequence
  Synthetic oligonucleotide
uggugguccacaugccccg

SEQ ID NO: 3355 - RNA, 19 nt, Artificial Sequence
  Synthetic oligonucleotide
ggugguccacaugccccgc

SEQ ID NO: 3356 - RNA, 19 nt, Artificial Sequence
  Synthetic oligonucleotide
gugguccacaugccccgcu

SEQ ID NO: 3357 - RNA, 19 nt, Artificial Sequence
  Synthetic oligonucleotide
ugguccacaugccccgcuu

SEQ ID NO: 3358 - RNA, 19 nt, Artificial Sequence
  Synthetic oligonucleotide
gguccacaugccccgcuuc

SEQ ID NO: 3359 - RNA, 19 nt, Artificial Sequence
  Synthetic oligonucleotide
guccacaugccccgcuucc

SEQ ID NO: 3360 - RNA, 19 nt, Artificial Sequence
  Synthetic oligonucleotide
uccacaugccccgcuuccg

SEQ ID NO: 3361 - RNA, 19 nt, Artificial Sequence
  Synthetic oligonucleotide
ucaguuugaaggagcagcu

SEQ ID NO: 3362 - RNA, 19 nt, Artificial Sequence
  Synthetic oligonucleotide
caguuugaaggagcagcug

SEQ ID NO: 3363 - RNA, 19 nt, Artificial Sequence
  Synthetic oligonucleotide
uuugaaggagcagcugcaa

SEQ ID NO: 3364 - RNA, 19 nt, Artificial Sequence
  Synthetic oligonucleotide
uugaaggagcagcugcaag

SEQ ID NO: 3365 - RNA, 19 nt, Artificial Sequence
  Synthetic oligonucleotide
ugaaggagcagcugcaaga

SEQ ID NO: 3366 - RNA, 19 nt, Artificial Sequence
  Synthetic oligonucleotide
gaaggagcagcugcaagac

SEQ ID NO: 3367 - RNA, 19 nt, Artificial Sequence
  Synthetic oligonucleotide
aaggagcagcugcaagaca

SEQ ID NO: 3368 - RNA, 19 nt, Artificial Sequence
  Synthetic oligonucleotide
aggagcagcugcaagacau

SEQ ID NO: 3369 - RNA, 19 nt, Artificial Sequence
  Synthetic oligonucleotide
ggagcagcugcaagacaug

SEQ ID NO: 3370 - RNA, 19 nt, Artificial Sequence
  Synthetic oligonucleotide
gagcagcugcaagacaugg

SEQ ID NO: 3371 - RNA, 19 nt, Artificial Sequence
  Synthetic oligonucleotide
agcagcugcaagacauggg

SEQ ID NO: 3372 - RNA, 19 nt, Artificial Sequence
  Synthetic oligonucleotide
gcagcugcaagacaugggc

SEQ ID NO: 3373 - RNA, 19 nt, Artificial Sequence
  Synthetic oligonucleotide
ccuugucgaucuguucagc

SEQ ID NO: 3374 - RNA, 19 nt, Artificial Sequence
  Synthetic oligonucleotide
uugucgaucuguucagccc

SEQ ID NO: 3375 - RNA, 19 nt, Artificial Sequence
  Synthetic oligonucleotide
ugucgaucuguucagcccu

SEQ ID NO: 3376 - RNA, 19 nt, Artificial Sequence
  Synthetic oligonucleotide
ucgaucuguucagcccuga

SEQ ID NO: 3377 - RNA, 19 nt, Artificial Sequence
  Synthetic oligonucleotide
aucuguucagcccugaaaa

SEQ ID NO: 3378 - RNA, 19 nt, Artificial Sequence
  Synthetic oligonucleotide
cuguucagcccugaaaagu

SEQ ID NO: 3379 - RNA, 19 nt, Artificial Sequence
  Synthetic oligonucleotide
gaaaaguccaaacucccag

SEQ ID NO: 3380 - RNA, 19 nt, Artificial Sequence
  Synthetic oligonucleotide
aaaaguccaaacucccagg

SEQ ID NO: 3381 - RNA, 19 nt, Artificial Sequence
  Synthetic oligonucleotide
aaguccaaacucccaggua

SEQ ID NO: 3382 - RNA, 19 nt, Artificial Sequence
  Synthetic oligonucleotide
guccaaacucccagguauu

SEQ ID NO: 3383 - RNA, 19 nt, Artificial Sequence
  Synthetic oligonucleotide
uccaaacucccagguauug

SEQ ID NO: 3384 - RNA, 19 nt, Artificial Sequence
  Synthetic oligonucleotide
ccaaacucccagguauugu

SEQ ID NO: 3385 - RNA, 19 nt, Artificial Sequence
  Synthetic oligonucleotide
caaacucccagguauuguu

SEQ ID NO: 3386 - RNA, 19 nt, Artificial Sequence
  Synthetic oligonucleotide
uccauaaggcauuucuuga

SEQ ID NO: 3387 - RNA, 19 nt, Artificial Sequence
  Synthetic oligonucleotide
ccauaaggcauuucuugag

SEQ ID NO: 3388 - RNA, 19 nt, Artificial Sequence
  Synthetic oligonucleotide
cauaaggcauuucuugagg

SEQ ID NO: 3389 - RNA, 19 nt, Artificial Sequence
  Synthetic oligonucleotide
auaaggcauuucuugaggu

SEQ ID NO: 3390 - RNA, 19 nt, Artificial Sequence
  Synthetic oligonucleotide
uaaggcauuucuugaggua

SEQ ID NO: 3391 - RNA, 19 nt, Artificial Sequence
  Synthetic oligonucleotide
aaggcauuucuugagguaa

SEQ ID NO: 3392 - RNA, 19 nt, Artificial Sequence
  Synthetic oligonucleotide
aggcauuucuugagguaaa

SEQ ID NO: 3393 - RNA, 19 nt, Artificial Sequence
  Synthetic oligonucleotide
ggcauuucuugagguaaau

SEQ ID NO: 3394 - RNA, 19 nt, Artificial Sequence
  Synthetic oligonucleotide
cuugagguaaaugaagaag

SEQ ID NO: 3395 - RNA, 19 nt, Artificial Sequence
  Synthetic oligonucleotide
uugagguaaaugaagaagg

SEQ ID NO: 3396 - RNA, 19 nt, Artificial Sequence
  Synthetic oligonucleotide
ugagguaaaugaagaaggc

SEQ ID NO: 3397 - RNA, 19 nt, Artificial Sequence
  Synthetic oligonucleotide
gagguaaaugaagaaggca

SEQ ID NO: 3398 - RNA, 19 nt, Artificial Sequence
  Synthetic oligonucleotide
agguaaaugaagaaggcag

SEQ ID NO: 3399 - RNA, 19 nt, Artificial Sequence
  Synthetic oligonucleotide
gguaaaugaagaaggcagu

SEQ ID NO: 3400 - RNA, 19 nt, Artificial Sequence
  Synthetic oligonucleotide
guaaaugaagaaggcagug

SEQ ID NO: 3401 - RNA, 19 nt, Artificial Sequence
  Synthetic oligonucleotide
ugaagaaggcagugaagca

SEQ ID NO: 3402 - RNA, 19 nt, Artificial Sequence
  Synthetic oligonucleotide
agaaggcagugaagcagcu

SEQ ID NO: 3403 - RNA, 19 nt, Artificial Sequence
  Synthetic oligonucleotide
gaaggcagugaagcagcug

SEQ ID NO: 3404 - RNA, 19 nt, Artificial Sequence
  Synthetic oligonucleotide
ugaagcagcugcaaguacc

SEQ ID NO: 3405 - RNA, 19 nt, Artificial Sequence
  Synthetic oligonucleotide
ccaacaggccuuuccuggu

SEQ ID NO: 3406 - RNA, 19 nt, Artificial Sequence
  Synthetic oligonucleotide
caacaggccuuuccugguu

SEQ ID NO: 3407 - RNA, 19 nt, Artificial Sequence
  Synthetic oligonucleotide
aacaggccuuuccugguuu

SEQ ID NO: 3408 - RNA, 19 nt, Artificial Sequence
  Synthetic oligonucleotide
acaggccuuuccugguuuu

SEQ ID NO: 3409 - RNA, 19 nt, Artificial Sequence
  Synthetic oligonucleotide
caggccuuuccugguuuuu

SEQ ID NO: 3410 - RNA, 19 nt, Artificial Sequence
  Synthetic oligonucleotide
aggccuuuccugguuuuua

SEQ ID NO: 3411 - RNA, 19 nt, Artificial Sequence
  Synthetic oligonucleotide
gccuuuccugguuuuuaua

SEQ ID NO: 3412 - RNA, 19 nt, Artificial Sequence
  Synthetic oligonucleotide
ccuuuccugguuuuuauaa

SEQ ID NO: 3413 - RNA, 19 nt, Artificial Sequence
  Synthetic oligonucleotide
cuuuccugguuuuuauaag

SEQ ID NO: 3414 - RNA, 19 nt, Artificial Sequence
  Synthetic oligonucleotide
uuuccugguuuuuauaaga

SEQ ID NO: 3415 - RNA, 19 nt, Artificial Sequence
  Synthetic oligonucleotide
uuccugguuuuuauaagag

SEQ ID NO: 3416 - RNA, 19 nt, Artificial Sequence
  Synthetic oligonucleotide
uccugguuuuuauaagaga

SEQ ID NO: 3417 - RNA, 19 nt, Artificial Sequence
  Synthetic oligonucleotide
ccugguuuuuauaagagaa

SEQ ID NO: 3418 - RNA, 19 nt, Artificial Sequence
  Synthetic oligonucleotide
cugguuuuuauaagagaag

SEQ ID NO: 3419 - RNA, 19 nt, Artificial Sequence
  Synthetic oligonucleotide
ugguuuuuauaagagaagu

SEQ ID NO: 3420 - RNA, 19 nt, Artificial Sequence
  Synthetic oligonucleotide
gguuuuuauaagagaaguu

SEQ ID NO: 3421 - RNA, 19 nt, Artificial Sequence
  Synthetic oligonucleotide
guuuuuauaagagaaguuc

SEQ ID NO: 3422 - RNA, 19 nt, Artificial Sequence
  Synthetic oligonucleotide
uuuuuauaagagaaguucc

SEQ ID NO: 3423 - RNA, 19 nt, Artificial Sequence
  Synthetic oligonucleotide
uuuuauaagagaaguuccu

SEQ ID NO: 3424 - RNA, 19 nt, Artificial Sequence
  Synthetic oligonucleotide
uuuauaagagaaguuccuc

SEQ ID NO: 3425 - RNA, 19 nt, Artificial Sequence
  Synthetic oligonucleotide
uuauaagagaaguuccucu

SEQ ID NO: 3426 - RNA, 19 nt, Artificial Sequence
  Synthetic oligonucleotide
uauaagagaaguuccucug

SEQ ID NO: 3427 - RNA, 19 nt, Artificial Sequence
  Synthetic oligonucleotide
auaagagaaguuccucuga

SEQ ID NO: 3428 - RNA, 19 nt, Artificial Sequence
  Synthetic oligonucleotide
uaagagaaguuccucugaa

SEQ ID NO: 3429 - RNA, 19 nt, Artificial Sequence
  Synthetic oligonucleotide
aagagaaguuccucugaac

SEQ ID NO: 3430 - RNA, 19 nt, Artificial Sequence
  Synthetic oligonucleotide
agagaaguuccucugaaca

SEQ ID NO: 3431 - RNA, 19 nt, Artificial Sequence
  Synthetic oligonucleotide
gagaaguuccucugaacac

SEQ ID NO: 3432 - RNA, 19 nt, Artificial Sequence
  Synthetic oligonucleotide
agaaguuccucugaacacu

SEQ ID NO: 3433 - RNA, 19 nt, Artificial Sequence
  Synthetic oligonucleotide
gaaguuccucugaacacua

SEQ ID NO: 3434 - RNA, 19 nt, Artificial Sequence
  Synthetic oligonucleotide
aaguuccucugaacacuau

SEQ ID NO: 3435 - RNA, 19 nt, Artificial Sequence
  Synthetic oligonucleotide
aguuccucugaacacuauu

SEQ ID NO: 3436 - RNA, 19 nt, Artificial Sequence
  Synthetic oligonucleotide
guuccucugaacacuauua

SEQ ID NO: 3437 - RNA, 19 nt, Artificial Sequence
  Synthetic oligonucleotide
uuccucugaacacuauuau

SEQ ID NO: 3438 - RNA, 19 nt, Artificial Sequence
  Synthetic oligonucleotide
uccucugaacacuauuauc

SEQ ID NO: 3439 - RNA, 19 nt, Artificial Sequence
  Synthetic oligonucleotide
cucugaacacuauuaucuu

SEQ ID NO: 3440 - RNA, 19 nt, Artificial Sequence
  Synthetic oligonucleotide
aacacuauuaucuucaugg

SEQ ID NO: 3441 - RNA, 19 nt, Artificial Sequence
  Synthetic oligonucleotide
acagaaguaaaaauaaaua

SEQ ID NO: 3442 - RNA, 19 nt, Artificial Sequence
  Synthetic oligonucleotide
cagaaguaaaaauaaauac

SEQ ID NO: 3443 - RNA, 19 nt, Artificial Sequence
  Synthetic oligonucleotide
guggugagauauaagacau

SEQ ID NO: 3444 - RNA, 19 nt, Artificial Sequence
  Synthetic oligonucleotide
caagcagcugauggagguu

SEQ ID NO: 3445 - RNA, 19 nt, Artificial Sequence
  Synthetic oligonucleotide
ugauggagguuuuuaaauu

SEQ ID NO: 3446 - RNA, 19 nt, Artificial Sequence
  Synthetic oligonucleotide
agggaaguugcacugaaca

SEQ ID NO: 3447 - RNA, 19 nt, Artificial Sequence
  Synthetic oligonucleotide
gaaguugcacugaacacua

SEQ ID NO: 3448 - RNA, 19 nt, Artificial Sequence
  Synthetic oligonucleotide
aguugcacugaacacuauu

SEQ ID NO: 3449 - RNA, 19 nt, Artificial Sequence
  Synthetic oligonucleotide
uacuuugguguuugugaau

SEQ ID NO: 3450 - RNA, 19 nt, Artificial Sequence
  Synthetic oligonucleotide
uugguguuugugaauagaa

SEQ ID NO: 3451 - RNA, 19 nt, Artificial Sequence
  Synthetic oligonucleotide
ugguguuugugaauagaag

SEQ ID NO: 3452 - RNA, 19 nt, Artificial Sequence
  Synthetic oligonucleotide
gguguuugugaauagaagu

SEQ ID NO: 3453 - RNA, 19 nt, Artificial Sequence
  Synthetic oligonucleotide
guguuugugaauagaagua

SEQ ID NO: 3454 - RNA, 19 nt, Artificial Sequence
  Synthetic oligonucleotide
uugugaauagaaguaaaaa

SEQ ID NO: 3455 - RNA, 19 nt, Artificial Sequence
  Synthetic oligonucleotide
acaagagguaaauauauua

SEQ ID NO: 3456 - RNA, 19 nt, Artificial Sequence
  Synthetic oligonucleotide
agagaaaugcauuuuuaua

SEQ ID NO: 3457 - RNA, 21 nt, Artificial Sequence
  Synthetic oligonucleotide
ccuaucacauuggaauacaug

SEQ ID NO: 3458 - RNA, 27 nt, Artificial Sequence
  Synthetic oligonucleotide
cauguauuccaaugugauaggaacuac

SEQ ID NO: 3459 - RNA, 21 nt, Artificial Sequence
  Synthetic oligonucleotide
cauguauuccaaugugauaaa

SEQ ID NO: 3460 - DNA, 25 bp, Artificial Sequence
  Synthetic oligonucleotide
uguauuccaaugugauagaaacugt

SEQ ID NO: 3461 - DNA, 25 bp, Artificial Sequence
  Synthetic oligonucleotide
uguauuccaaugugauagguacugt

SEQ ID NO: 3462 - DNA, 25 bp, Artificial Sequence
  Synthetic oligonucleotide
uguauuccaaugugauaggaucugt

SEQ ID NO: 3463 - DNA, 25 bp, Artificial Sequence
  Synthetic oligonucleotide
uguauuccaaugugauaggaauugt

SEQ ID NO: 3464 - DNA, 25 bp, Artificial Sequence
  Synthetic oligonucleotide
uguauuccaaugugauaggaacagt

SEQ ID NO: 3465 - DNA, 25 bp, Artificial Sequence
  Synthetic oligonucleotide
uguauuccaaugugauaggaacutt

SEQ ID NO: 3466 - DNA, 25 bp, Artificial Sequence
  Synthetic oligonucleotide
uguauuccaaugugauaggaacuga

SEQ ID NO: 3467 - RNA, 27 nt, Artificial Sequence
  Synthetic oligonucleotide
ucaguuccuaucacauuggaauacaug

SEQ ID NO: 3468 - RNA, 27 nt, Artificial Sequence
  Synthetic oligonucleotide
aaaguuccuaucacauuggaauacaug

SEQ ID NO: 3469 - RNA, 27 nt, Artificial Sequence
  Synthetic oligonucleotide
acuguuccuaucacauuggaauacaug

SEQ ID NO: 3470 - RNA, 27 nt, Artificial Sequence
  Synthetic oligonucleotide
acaauuccuaucacauuggaauacaug

SEQ ID NO: 3471 - RNA, 27 nt, Artificial Sequence
  Synthetic oligonucleotide
acagauccuaucacauuggaauacaug

SEQ ID NO: 3472 - RNA, 27 nt, Artificial Sequence
  Synthetic oligonucleotide
acaguaccuaucacauuggaauacaug

SEQ ID NO: 3473 - RNA, 27 nt, Artificial Sequence
  Synthetic oligonucleotide
acaguuucuaucacauuggaauacaug

SEQ ID NO: 3474 - DNA, 25 bp, Artificial Sequence
  Synthetic oligonucleotide
aaaaaggaagguuuaucuauugucc

SEQ ID NO: 3475 - DNA, 25 bp, Artificial Sequence
  Synthetic oligonucleotide
aaaaaggaagguuuaucuuaugucc

SEQ ID NO: 3476 - DNA, 25 bp, Artificial Sequence
  Synthetic oligonucleotide
aaaaaggaagguuuaucuuuagucc

SEQ ID NO: 3477 - DNA, 25 bp, Artificial Sequence
  Synthetic oligonucleotide
aaaaaggaagguuuaucuuuuuucc

SEQ ID NO: 3478 - DNA, 25 bp, Artificial Sequence
  Synthetic oligonucleotide
aaaaaggaagguuuaucuuuugacc

SEQ ID NO: 3479 - DNA, 25 bp, Artificial Sequence
  Synthetic oligonucleotide
aaaaaggaagguuuaucuuuugutc

SEQ ID NO: 3480 - DNA, 25 bp, Artificial Sequence
  Synthetic oligonucleotide
aaaaaggaagguuuaucuuuuguca

SEQ ID NO: 3481 - RNA, 27 nt, Artificial Sequence
  Synthetic oligonucleotide
ugacaaaagauaaaccuuccuuuuucc

SEQ ID NO: 3482 - RNA, 27 nt, Artificial Sequence
  Synthetic oligonucleotide
gaacaaaagauaaaccuuccuuuuucc

SEQ ID NO: 3483 - RNA, 27 nt, Artificial Sequence
  Synthetic oligonucleotide
ggucaaaagauaaaccuuccuuuuucc

SEQ ID NO: 3484 - RNA, 27 nt, Artificial Sequence
  Synthetic oligonucleotide
ggaaaaaagauaaaccuuccuuuuucc

SEQ ID NO: 3485 - RNA, 27 nt, Artificial Sequence
  Synthetic oligonucleotide
ggacuaaagauaaaccuuccuuuuucc

SEQ ID NO: 3486 - RNA, 27 nt, Artificial Sequence
  Synthetic oligonucleotide
ggacauaagauaaaccuuccuuuuucc

SEQ ID NO: 3487 - RNA, 27 nt, Artificial Sequence
  Synthetic oligonucleotide
ggacaauagauaaaccuuccuuuuucc

SEQ ID NO: 3488 - DNA, 25 bp, Artificial Sequence
  Synthetic oligonucleotide
acugccgacucuaucgaauagccaa

SEQ ID NO: 3489 - DNA, 25 bp, Artificial Sequence
  Synthetic oligonucleotide
acugccgacucuaucgaaaugccaa

SEQ ID NO: 3490 - DNA, 25 bp, Artificial Sequence
  Synthetic oligonucleotide
acugccgacucuaucgaaaaaccaa

SEQ ID NO: 3491 - DNA, 25 bp, Artificial Sequence
  Synthetic oligonucleotide
acugccgacucuaucgaaaagucaa

SEQ ID NO: 3492 - DNA, 25 bp, Artificial Sequence
  Synthetic oligonucleotide
acugccgacucuaucgaaaagcaaa

SEQ ID NO: 3493 - DNA, 25 bp, Artificial Sequence
  Synthetic oligonucleotide
acugccgacucuaucgaaaagccga

SEQ ID NO: 3494 - DNA, 25 bp, Artificial Sequence
  Synthetic oligonucleotide
acugccgacucuaucgaaaagccat

SEQ ID NO: 3495 - RNA, 27 nt, Artificial Sequence
  Synthetic oligonucleotide
auggcuuuucgauagagucggcaguuc

SEQ ID NO: 3496 - RNA, 27 nt, Artificial Sequence
  Synthetic oligonucleotide
ucggcuuuucgauagagucggcaguuc

SEQ ID NO: 3497 - RNA, 27 nt, Artificial Sequence
  Synthetic oligonucleotide
uuugcuuuucgauagagucggcaguuc

SEQ ID NO: 3498 - RNA, 27 nt, Artificial Sequence
  Synthetic oligonucleotide
uugacuuuucgauagagucggcaguuc

SEQ ID NO: 3499 - RNA, 27 nt, Artificial Sequence
  Synthetic oligonucleotide
uugguuuuucgauagagucggcaguuc

SEQ ID NO: 3500 - RNA, 27 nt, Artificial Sequence
  Synthetic oligonucleotide
uuggcauuucgauagagucggcaguuc

SEQ ID NO: 3501 - RNA, 27 nt, Artificial Sequence
  Synthetic oligonucleotide
uuggcuauucgauagagucggcaguuc

SEQ ID NO: 3502 - DNA, 25 bp, Artificial Sequence
  Synthetic oligonucleotide
augauguaccaggaaggcuaguucc

SEQ ID NO: 3503 - DNA, 25 bp, Artificial Sequence
  Synthetic oligonucleotide
augauguaccaggaaggcauguucc

SEQ ID NO: 3504 - DNA, 25 bp, Artificial Sequence
  Synthetic oligonucleotide
augauguaccaggaaggcaaauucc

SEQ ID NO: 3505 - DNA, 25 bp, Artificial Sequence
  Synthetic oligonucleotide
augauguaccaggaaggcaaggucc

SEQ ID NO: 3506 - DNA, 25 bp, Artificial Sequence
  Synthetic oligonucleotide
augauguaccaggaaggcaaguacc

SEQ ID NO: 3507 - DNA, 25 bp, Artificial Sequence
  Synthetic oligonucleotide
augauguaccaggaaggcaaguutc

SEQ ID NO: 3508 - DNA, 25 bp, Artificial Sequence
  Synthetic oligonucleotide
augauguaccaggaaggcaaguuca

SEQ ID NO: 3509 - RNA, 27 nt, Artificial Sequence
  Synthetic oligonucleotide
ugaacuugccuuccugguacaucauag

SEQ ID NO: 3510 - RNA, 27 nt, Artificial Sequence
  Synthetic oligonucleotide
gaaacuugccuuccugguacaucauag

SEQ ID NO: 3511 - RNA, 27 nt, Artificial Sequence
  Synthetic oligonucleotide
gguacuugccuuccugguacaucauag

SEQ ID NO: 3512 - RNA, 27 nt, Artificial Sequence
  Synthetic oligonucleotide
ggaccuugccuuccugguacaucauag

SEQ ID NO: 3513 - RNA, 27 nt, Artificial Sequence
  Synthetic oligonucleotide
ggaauuugccuuccugguacaucauag

SEQ ID NO: 3514 - RNA, 27 nt, Artificial Sequence
  Synthetic oligonucleotide
ggaacaugccuuccugguacaucauag

SEQ ID NO: 3515 - RNA, 27 nt, Artificial Sequence
  Synthetic oligonucleotide
ggaacuagccuuccugguacaucauag

SEQ ID NO: 3516 - DNA, 25 bp, Artificial Sequence
  Synthetic oligonucleotide
gaaguaaaaauaaauacauacuact

SEQ ID NO: 3517 - DNA, 25 bp, Artificial Sequence
  Synthetic oligonucleotide
gaaguaaaaauaaauacaaucuact

SEQ ID NO: 3518 - DNA, 25 bp, Artificial Sequence
  Synthetic oligonucleotide
gaaguaaaaauaaauacaaaauact

SEQ ID NO: 3519 - DNA, 25 bp, Artificial Sequence
  Synthetic oligonucleotide
gaaguaaaaauaaauacaaacgact

SEQ ID NO: 3520 - DNA, 25 bp, Artificial Sequence
  Synthetic oligonucleotide
gaaguaaaaauaaauacaaacuuct

SEQ ID NO: 3521 - DNA, 25 bp, Artificial Sequence
  Synthetic oligonucleotide
gaaguaaaaauaaauacaaacuatt

SEQ ID NO: 3522 - DNA, 25 bp, Artificial Sequence
  Synthetic oligonucleotide
gaaguaaaaauaaauacaaacuaca

SEQ ID NO: 3523 - RNA, 27 nt, Artificial Sequence
  Synthetic oligonucleotide
uguaguuuguauuuauuuuuacuucug

SEQ ID NO: 3524 - RNA, 27 nt, Artificial Sequence
  Synthetic oligonucleotide
aauaguuuguauuuauuuuuacuucug

SEQ ID NO: 3525 - RNA, 27 nt, Artificial Sequence
  Synthetic oligonucleotide
agaaguuuguauuuauuuuuacuucug

SEQ ID NO: 3526 - RNA, 27 nt, Artificial Sequence
  Synthetic oligonucleotide
agucguuuguauuuauuuuuacuucug

SEQ ID NO: 3527 - RNA, 27 nt, Artificial Sequence
  Synthetic oligonucleotide
aguauuuuguauuuauuuuuacuucug

SEQ ID NO: 3528 - RNA, 27 nt, Artificial Sequence
  Synthetic oligonucleotide
aguagauuguauuuauuuuuacuucug

SEQ ID NO: 3529 - RNA, 27 nt, Artificial Sequence
  Synthetic oligonucleotide
aguaguauguauuuauuuuuacuucug

SEQ ID NO: 3530 - DNA, 25 bp, Artificial Sequence
  Synthetic oligonucleotide
  misc_feature (19)..(25): n is a, c, g, t or u
uguauuccaaugugauagnnnnnnn

SEQ ID NO: 3531 - RNA, 27 nt, Artificial Sequence
  Synthetic oligonucleotide
  misc_feature (1)..(7): n is a, c, g, or u
nnnnnnncuaucacauuggaauacaug

SEQ ID NO: 3532 - RNA, 27 nt, Artificial Sequence
  Synthetic oligonucleotide
  misc_feature (21)..(27): n is a, c, g, or u
cauguauuccaaugugauagnnnnnnn

SEQ ID NO: 3533 - RNA, 33 nt, Artificial Sequence
  Synthetic oligonucleotide
ggccauguauuccaaugugauaggaacuguaac

SEQ ID NO: 3534 - DNA, 37 bp, Artificial Sequence
  Synthetic oligonucleotide
  misc_feature (11)..(37): n is a, c, g, t or u
tgcuaucgaunnnnnnnnnnnnnnnnnnnnnnnnnnn

SEQ ID NO: 3535 - RNA, 36 nt, Artificial Sequence
  Synthetic oligonucleotide
ccauguauuccaaugugauagcagccgaaaggcugc

SEQ ID NO: 3536 - RNA, 36 nt, Artificial Sequence
  Synthetic oligonucleotide
cauguauuccaaugugauaggcagccgaaaggcugc

SEQ ID NO: 3537 - RNA, 36 nt, Artificial Sequence
  Synthetic oligonucleotide
auguauuccaaugugauagggcagccgaaaggcugc

SEQ ID NO: 3538 - RNA, 36 nt, Artificial Sequence
  Synthetic oligonucleotide
uguauuccaaugugauaggagcagccgaaaggcugc

SEQ ID NO: 3539 - RNA, 36 nt, Artificial Sequence
  Synthetic oligonucleotide
guauuccaaugugauaggaagcagccgaaaggcugc

SEQ ID NO: 3540 - RNA, 36 nt, Artificial Sequence
  Synthetic oligonucleotide
uauuccaaugugauaggaacgcagccgaaaggcugc

SEQ ID NO: 3541 - RNA, 36 nt, Artificial Sequence
  Synthetic oligonucleotide
auuccaaugugauaggaacugcagccgaaaggcugc

SEQ ID NO: 3542 - RNA, 36 nt, Artificial Sequence
  Synthetic oligonucleotide
cucuggaaaaaggaagguuugcagccgaaaggcugc

SEQ ID NO: 3543 - RNA, 36 nt, Artificial Sequence
  Synthetic oligonucleotide
ucuggaaaaaggaagguuuagcagccgaaaggcugc

SEQ ID NO: 3544 - RNA, 36 nt, Artificial Sequence
  Synthetic oligonucleotide
ggaaaaaggaagguuuaucugcagccgaaaggcugc

SEQ ID NO: 3545 - RNA, 36 nt, Artificial Sequence
  Synthetic oligonucleotide
gaaaaaggaagguuuaucuugcagccgaaaggcugc

SEQ ID NO: 3546 - RNA, 36 nt, Artificial Sequence
  Synthetic oligonucleotide
aaaaaggaagguuuaucuuugcagccgaaaggcugc

SEQ ID NO: 3547 - RNA, 36 nt, Artificial Sequence
  Synthetic oligonucleotide
ucccaugaaucccaugugcagcagccgaaaggcugc

SEQ ID NO: 3548 - RNA, 36 nt, Artificial Sequence
  Synthetic oligonucleotide
cccaugaaucccaugugcaugcagccgaaaggcugc

SEQ ID NO: 3549 - RNA, 36 nt, Artificial Sequence
  Synthetic oligonucleotide
augaaucccaugugcauuuagcagccgaaaggcugc

SEQ ID NO: 3550 - RNA, 36 nt, Artificial Sequence
  Synthetic oligonucleotide
auucccgcuuugcuaccacugcagccgaaaggcugc

SEQ ID NO: 3551 - RNA, 36 nt, Artificial Sequence
  Synthetic oligonucleotide
cccgcuuugcuaccacuuucgcagccgaaaggcugc

SEQ ID NO: 3552 - RNA, 36 nt, Artificial Sequence
  Synthetic oligonucleotide
ccgcuuugcuaccacuuucugcagccgaaaggcugc

SEQ ID NO: 3553 - RNA, 36 nt, Artificial Sequence
  Synthetic oligonucleotide
cgcuuugcuaccacuuucuagcagccgaaaggcugc

SEQ ID NO: 3554 - RNA, 36 nt, Artificial Sequence
  Synthetic oligonucleotide
gcuuugcuaccacuuucuaugcagccgaaaggcugc

SEQ ID NO: 3555 - RNA, 36 nt, Artificial Sequence
  Synthetic oligonucleotide
cuuugcuaccacuuucuaucgcagccgaaaggcugc

SEQ ID NO: 3556 - RNA, 36 nt, Artificial Sequence
  Synthetic oligonucleotide
gcuaccacuuucuaucagcagcagccgaaaggcugc

SEQ ID NO: 3557 - RNA, 36 nt, Artificial Sequence
  Synthetic oligonucleotide
augaccaagcugggugccuggcagccgaaaggcugc

SEQ ID NO: 3558 - RNA, 36 nt, Artificial Sequence
  Synthetic oligonucleotide
uauuuaaguuugacaccauagcagccgaaaggcugc

SEQ ID NO: 3559 - RNA, 36 nt, Artificial Sequence
  Synthetic oligonucleotide
aaguuugacaccauaucugagcagccgaaaggcugc

SEQ ID NO: 3560 - RNA, 36 nt, Artificial Sequence
  Synthetic oligonucleotide
aguuugacaccauaucugaggcagccgaaaggcugc

SEQ ID NO: 3561 - RNA, 36 nt, Artificial Sequence
  Synthetic oligonucleotide
acaccauaucugagaaaacagcagccgaaaggcugc

SEQ ID NO: 3562 - RNA, 36 nt, Artificial Sequence
  Synthetic oligonucleotide
caccauaucugagaaaacaugcagccgaaaggcugc

SEQ ID NO: 3563 - RNA, 36 nt, Artificial Sequence
  Synthetic oligonucleotide
cauaucugagaaaacaucuggcagccgaaaggcugc

SEQ ID NO: 3564 - RNA, 36 nt, Artificial Sequence
  Synthetic oligonucleotide
auaucugagaaaacaucugagcagccgaaaggcugc

SEQ ID NO: 3565 - RNA, 36 nt, Artificial Sequence
  Synthetic oligonucleotide
uaucugagaaaacaucugaugcagccgaaaggcugc

SEQ ID NO: 3566 - RNA, 36 nt, Artificial Sequence
  Synthetic oligonucleotide
ugagaaaacaucugaucagagcagccgaaaggcugc

SEQ ID NO: 3567 - RNA, 36 nt, Artificial Sequence
  Synthetic oligonucleotide
agaaaacaucugaucagaucgcagccgaaaggcugc

SEQ ID NO: 3568 - RNA, 36 nt, Artificial Sequence
  Synthetic oligonucleotide
aucagauccacuucuucuuugcagccgaaaggcugc

SEQ ID NO: 3569 - RNA, 36 nt, Artificial Sequence
  Synthetic oligonucleotide
auccacuucuucuuugccaagcagccgaaaggcugc

SEQ ID NO: 3570 - RNA, 36 nt, Artificial Sequence
  Synthetic oligonucleotide
uccacuucuucuuugccaaagcagccgaaaggcugc

SEQ ID NO: 3571 - RNA, 36 nt, Artificial Sequence
  Synthetic oligonucleotide
uucuucuuugccaaacugaagcagccgaaaggcugc

SEQ ID NO: 3572 - RNA, 36 nt, Artificial Sequence
  Synthetic oligonucleotide
ccaaacugaacugccgacucgcagccgaaaggcugc

SEQ ID NO: 3573 - RNA, 36 nt, Artificial Sequence
  Synthetic oligonucleotide
caaacugaacugccgacucugcagccgaaaggcugc

SEQ ID NO: 3574 - RNA, 36 nt, Artificial Sequence
  Synthetic oligonucleotide
aaacugaacugccgacucuagcagccgaaaggcugc

SEQ ID NO: 3575 - RNA, 36 nt, Artificial Sequence
  Synthetic oligonucleotide
aacugccgacucuaucgaaagcagccgaaaggcugc

SEQ ID NO: 3576 - RNA, 36 nt, Artificial Sequence
  Synthetic oligonucleotide
acugccgacucuaucgaaaagcagccgaaaggcugc

SEQ ID NO: 3577 - RNA, 36 nt, Artificial Sequence
  Synthetic oligonucleotide
cugccgacucuaucgaaaaggcagccgaaaggcugc

SEQ ID NO: 3578 - RNA, 36 nt, Artificial Sequence
  Synthetic oligonucleotide
cgacucuaucgaaaagccaagcagccgaaaggcugc

SEQ ID NO: 3579 - RNA, 36 nt, Artificial Sequence
  Synthetic oligonucleotide
ucuaucgaaaagccaacaaagcagccgaaaggcugc

SEQ ID NO: 3580 - RNA, 36 nt, Artificial Sequence
  Synthetic oligonucleotide
aaaagccaacaaauccuccagcagccgaaaggcugc

SEQ ID NO: 3581 - RNA, 36 nt, Artificial Sequence
  Synthetic oligonucleotide
ccaacaaauccuccaaguuagcagccgaaaggcugc

SEQ ID NO: 3582 - RNA, 36 nt, Artificial Sequence
  Synthetic oligonucleotide
aucgccuuuuuggagacaaagcagccgaaaggcugc

SEQ ID NO: 3583 - RNA, 36 nt, Artificial Sequence
  Synthetic oligonucleotide
aucccuuaccuucaaugagagcagccgaaaggcugc

SEQ ID NO: 3584 - RNA, 36 nt, Artificial Sequence
  Synthetic oligonucleotide
cugguuaacaccauuuacuugcagccgaaaggcugc

SEQ ID NO: 3585 - RNA, 36 nt, Artificial Sequence
  Synthetic oligonucleotide
ugguuaacaccauuuacuucgcagccgaaaggcugc

SEQ ID NO: 3586 - RNA, 36 nt, Artificial Sequence
  Synthetic oligonucleotide
ccauuuacuucaagggccuggcagccgaaaggcugc

SEQ ID NO: 3587 - RNA, 36 nt, Artificial Sequence
  Synthetic oligonucleotide
ucaagggccuguggaagucagcagccgaaaggcugc

SEQ ID NO: 3588 - RNA, 36 nt, Artificial Sequence
  Synthetic oligonucleotide
caagggccuguggaagucaagcagccgaaaggcugc

SEQ ID NO: 3589 - RNA, 36 nt, Artificial Sequence
  Synthetic oligonucleotide
gccuguggaagucaaaguucgcagccgaaaggcugc

SEQ ID NO: 3590 - RNA, 36 nt, Artificial Sequence
  Synthetic oligonucleotide
ccuguggaagucaaaguucagcagccgaaaggcugc

SEQ ID NO: 3591 - RNA, 36 nt, Artificial Sequence
  Synthetic oligonucleotide
cuguggaagucaaaguucaggcagccgaaaggcugc

SEQ ID NO: 3592 - RNA, 36 nt, Artificial Sequence
  Synthetic oligonucleotide
uguggaagucaaaguucagcgcagccgaaaggcugc

SEQ ID NO: 3593 - RNA, 36 nt, Artificial Sequence
  Synthetic oligonucleotide
gauggagagucguguucagcgcagccgaaaggcugc

SEQ ID NO: 3594 - RNA, 36 nt, Artificial Sequence
  Synthetic oligonucleotide
auggagagucguguucagcagcagccgaaaggcugc

SEQ ID NO: 3595 - RNA, 36 nt, Artificial Sequence
  Synthetic oligonucleotide
augauguaccaggaaggcaagcagccgaaaggcugc

SEQ ID NO: 3596 - RNA, 36 nt, Artificial Sequence
  Synthetic oligonucleotide
aguuugaaggagcagcugcagcagccgaaaggcugc

SEQ ID NO: 3597 - RNA, 36 nt, Artificial Sequence
  Synthetic oligonucleotide
aaggagcagcugcaagacaugcagccgaaaggcugc

SEQ ID NO: 3598 - RNA, 36 nt, Artificial Sequence
  Synthetic oligonucleotide
aggagcagcugcaagacauggcagccgaaaggcugc

SEQ ID NO: 3599 - RNA, 36 nt, Artificial Sequence
  Synthetic oligonucleotide
cagcugcaagacaugggccugcagccgaaaggcugc

SEQ ID NO: 3600 - RNA, 36 nt, Artificial Sequence
  Synthetic oligonucleotide
aaguccaaacucccagguaugcagccgaaaggcugc

SEQ ID NO: 3601 - RNA, 36 nt, Artificial Sequence
  Synthetic oligonucleotide
ccaaacucccagguauuguugcagccgaaaggcugc

SEQ ID NO: 3602 - RNA, 36 nt, Artificial Sequence
  Synthetic oligonucleotide
cauaaggcauuucuugaggugcagccgaaaggcugc

SEQ ID NO: 3603 - RNA, 36 nt, Artificial Sequence
  Synthetic oligonucleotide
auaaggcauuucuugagguagcagccgaaaggcugc

SEQ ID NO: 3604 - RNA, 36 nt, Artificial Sequence
  Synthetic oligonucleotide
uaaggcauuucuugagguaagcagccgaaaggcugc

SEQ ID NO: 3605 - RNA, 36 nt, Artificial Sequence
  Synthetic oligonucleotide
aaggcauuucuugagguaaagcagccgaaaggcugc

SEQ ID NO: 3606 - RNA, 36 nt, Artificial Sequence
  Synthetic oligonucleotide
cauuucuugagguaaaugaagcagccgaaaggcugc

SEQ ID NO: 3607 - RNA, 36 nt, Artificial Sequence
  Synthetic oligonucleotide
aagaaggcagugaagcagcugcagccgaaaggcugc

SEQ ID NO: 3608 - RNA, 36 nt, Artificial Sequence
  Synthetic oligonucleotide
cuuuccugguuuuuauaagagcagccgaaaggcugc

SEQ ID NO: 3609 - RNA, 36 nt, Artificial Sequence
  Synthetic oligonucleotide
uuccugguuuuuauaagagagcagccgaaaggcugc

SEQ ID NO: 3610 - RNA, 36 nt, Artificial Sequence
  Synthetic oligonucleotide
ugguuuuuauaagagaaguugcagccgaaaggcugc

SEQ ID NO: 3611 - RNA, 36 nt, Artificial Sequence
  Synthetic oligonucleotide
auaagagaaguuccucugaagcagccgaaaggcugc

SEQ ID NO: 3612 - RNA, 36 nt, Artificial Sequence
  Synthetic oligonucleotide
aagagaaguuccucugaacagcagccgaaaggcugc

SEQ ID NO: 3613 - RNA, 36 nt, Artificial Sequence
  Synthetic oligonucleotide
agagaaguuccucugaacacgcagccgaaaggcugc

SEQ ID NO: 3614 - RNA, 36 nt, Artificial Sequence
  Synthetic oligonucleotide
agaaguuccucugaacacuagcagccgaaaggcugc

SEQ ID NO: 3615 - RNA, 36 nt, Artificial Sequence
  Synthetic oligonucleotide
gaaguuccucugaacacuaugcagccgaaaggcugc

SEQ ID NO: 3616 - RNA, 36 nt, Artificial Sequence
  Synthetic oligonucleotide
aaguuccucugaacacuauugcagccgaaaggcugc

SEQ ID NO: 3617 - RNA, 36 nt, Artificial Sequence
  Synthetic oligonucleotide
aguuccucugaacacuauuagcagccgaaaggcugc

SEQ ID NO: 3618 - RNA, 36 nt, Artificial Sequence
  Synthetic oligonucleotide
uuccucugaacacuauuaucgcagccgaaaggcugc

SEQ ID NO: 3619 - RNA, 36 nt, Artificial Sequence
  Synthetic oligonucleotide
ccucugaacacuauuaucuugcagccgaaaggcugc

SEQ ID NO: 3620 - RNA, 36 nt, Artificial Sequence
  Synthetic oligonucleotide
cucugaacacuauuaucuucgcagccgaaaggcugc

SEQ ID NO: 3621 - RNA, 36 nt, Artificial Sequence
  Synthetic oligonucleotide
cugaacacuauuaucuucaugcagccgaaaggcugc

SEQ ID NO: 3622 - RNA, 36 nt, Artificial Sequence
  Synthetic oligonucleotide
cacuauuaucuucaugggcagcagccgaaaggcugc

SEQ ID NO: 3623 - RNA, 36 nt, Artificial Sequence
  Synthetic oligonucleotide
agaaguaaaaauaaauacaagcagccgaaaggcugc

SEQ ID NO: 3624 - RNA, 36 nt, Artificial Sequence
  Synthetic oligonucleotide
gaaguaaaaauaaauacaaagcagccgaaaggcugc

SEQ ID NO: 3625 - RNA, 22 nt, Artificial Sequence
  Synthetic oligonucleotide
uaucacauuggaauacauggcc

SEQ ID NO: 3626 - RNA, 22 nt, Artificial Sequence
  Synthetic oligonucleotide
cuaucacauuggaauacauggc

SEQ ID NO: 3627 - RNA, 22 nt, Artificial Sequence
  Synthetic oligonucleotide
ccuaucacauuggaauacaugg

SEQ ID NO: 3628 - RNA, 22 nt, Artificial Sequence
  Synthetic oligonucleotide
uccuaucacauuggaauacaug

SEQ ID NO: 3629 - RNA, 22 nt, Artificial Sequence
  Synthetic oligonucleotide
uuccuaucacauuggaauacau

SEQ ID NO: 3630 - RNA, 22 nt, Artificial Sequence
  Synthetic oligonucleotide
guuccuaucacauuggaauaca

SEQ ID NO: 3631 - RNA, 22 nt, Artificial Sequence
  Synthetic oligonucleotide
aguuccuaucacauuggaauac

SEQ ID NO: 3632 - RNA, 22 nt, Artificial Sequence
  Synthetic oligonucleotide
aaaccuuccuuuuuccagaggu

SEQ ID NO: 3633 - RNA, 22 nt, Artificial Sequence
  Synthetic oligonucleotide
uaaaccuuccuuuuuccagagg

SEQ ID NO: 3634 - RNA, 22 nt, Artificial Sequence
  Synthetic oligonucleotide
agauaaaccuuccuuuuuccag

SEQ ID NO: 3635 - RNA, 22 nt, Artificial Sequence
  Synthetic oligonucleotide
aagauaaaccuuccuuuuucca

SEQ ID NO: 3636 - RNA, 22 nt, Artificial Sequence
  Synthetic oligonucleotide
aaagauaaaccuuccuuuuucc

SEQ ID NO: 3637 - RNA, 22 nt, Artificial Sequence
  Synthetic oligonucleotide
ugcacaugggauucaugggaau

SEQ ID NO: 3638 - RNA, 22 nt, Artificial Sequence
  Synthetic oligonucleotide
augcacaugggauucaugggaa

SEQ ID NO: 3639 - RNA, 22 nt, Artificial Sequence
  Synthetic oligonucleotide
uaaaugcacaugggauucaugg

SEQ ID NO: 3640 - RNA, 22 nt, Artificial Sequence
  Synthetic oligonucleotide
agugguagcaaagcgggaauug

SEQ ID NO: 3641 - RNA, 22 nt, Artificial Sequence
  Synthetic oligonucleotide
gaaagugguagcaaagcgggaa

SEQ ID NO: 3642 - RNA, 22 nt, Artificial Sequence
  Synthetic oligonucleotide
agaaagugguagcaaagcggga

SEQ ID NO: 3643 - RNA, 22 nt, Artificial Sequence
  Synthetic oligonucleotide
uagaaagugguagcaaagcggg

SEQ ID NO: 3644 - RNA, 22 nt, Artificial Sequence
  Synthetic oligonucleotide
auagaaagugguagcaaagcgg

SEQ ID NO: 3645 - RNA, 22 nt, Artificial Sequence
  Synthetic oligonucleotide
gauagaaagugguagcaaagcg

SEQ ID NO: 3646 - RNA, 22 nt, Artificial Sequence
  Synthetic oligonucleotide
ugcugauagaaagugguagcaa

SEQ ID NO: 3647 - RNA, 22 nt, Artificial Sequence
  Synthetic oligonucleotide
caggcacccagcuuggucauag

SEQ ID NO: 3648 - RNA, 22 nt, Artificial Sequence
  Synthetic oligonucleotide
uauggugucaaacuuaaauacc

SEQ ID NO: 3649 - RNA, 22 nt, Artificial Sequence
  Synthetic oligonucleotide
ucagauauggugucaaacuuaa

SEQ ID NO: 3650 - RNA, 22 nt, Artificial Sequence
  Synthetic oligonucleotide
cucagauauggugucaaacuua

SEQ ID NO: 3651 - RNA, 22 nt, Artificial Sequence
  Synthetic oligonucleotide
uguuuucucagauaugguguca

SEQ ID NO: 3652 - RNA, 22 nt, Artificial Sequence
  Synthetic oligonucleotide
auguuuucucagauaugguguc

SEQ ID NO: 3653 - RNA, 22 nt, Artificial Sequence
  Synthetic oligonucleotide
cagauguuuucucagauauggu

SEQ ID NO: 3654 - RNA, 22 nt, Artificial Sequence
  Synthetic oligonucleotide
ucagauguuuucucagauaugg

SEQ ID NO: 3655 - RNA, 22 nt, Artificial Sequence
  Synthetic oligonucleotide
aucagauguuuucucagauaug

SEQ ID NO: 3656 - RNA, 22 nt, Artificial Sequence
  Synthetic oligonucleotide
ucugaucagauguuuucucaga

SEQ ID NO: 3657 - RNA, 22 nt, Artificial Sequence
  Synthetic oligonucleotide
gaucugaucagauguuuucuca

SEQ ID NO: 3658 - RNA, 22 nt, Artificial Sequence
  Synthetic oligonucleotide
aaagaagaaguggaucugauca

SEQ ID NO: 3659 - RNA, 22 nt, Artificial Sequence
  Synthetic oligonucleotide
uuggcaaagaagaaguggaucu

SEQ ID NO: 3660 - RNA, 22 nt, Artificial Sequence
  Synthetic oligonucleotide
uuuggcaaagaagaaguggauc

SEQ ID NO: 3661 - RNA, 22 nt, Artificial Sequence
  Synthetic oligonucleotide
uucaguuuggcaaagaagaagu

SEQ ID NO: 3662 - RNA, 22 nt, Artificial Sequence
  Synthetic oligonucleotide
gagucggcaguucaguuuggca

SEQ ID NO: 3663 - RNA, 22 nt, Artificial Sequence
  Synthetic oligonucleotide
agagucggcaguucaguuuggc

SEQ ID NO: 3664 - RNA, 22 nt, Artificial Sequence
  Synthetic oligonucleotide
uagagucggcaguucaguuugg

SEQ ID NO: 3665 - RNA, 22 nt, Artificial Sequence
  Synthetic oligonucleotide
uuucgauagagucggcaguuca

SEQ ID NO: 3666 - RNA, 22 nt, Artificial Sequence
  Synthetic oligonucleotide
uuuucgauagagucggcaguuc

SEQ ID NO: 3667 - RNA, 22 nt, Artificial Sequence
  Synthetic oligonucleotide
cuuuucgauagagucggcaguu

SEQ ID NO: 3668 - RNA, 22 nt, Artificial Sequence
  Synthetic oligonucleotide
uuggcuuuucgauagagucggc

SEQ ID NO: 3669 - RNA, 22 nt, Artificial Sequence
  Synthetic oligonucleotide
uuuguuggcuuuucgauagagu

SEQ ID NO: 3670 - RNA, 22 nt, Artificial Sequence
  Synthetic oligonucleotide
uggaggauuuguuggcuuuucg

SEQ ID NO: 3671 - RNA, 22 nt, Artificial Sequence
  Synthetic oligonucleotide
uaacuuggaggauuuguuggcu

SEQ ID NO: 3672 - RNA, 22 nt, Artificial Sequence
  Synthetic oligonucleotide
uuugucuccaaaaaggcgauug

SEQ ID NO: 3673 - RNA, 22 nt, Artificial Sequence
  Synthetic oligonucleotide
ucucauugaagguaagggauuu

SEQ ID NO: 3674 - RNA, 22 nt, Artificial Sequence
  Synthetic oligonucleotide
aaguaaaugguguuaaccagca

SEQ ID NO: 3675 - RNA, 22 nt, Artificial Sequence
  Synthetic oligonucleotide
gaaguaaaugguguuaaccagc

SEQ ID NO: 3676 - RNA, 22 nt, Artificial Sequence
  Synthetic oligonucleotide
caggcccuugaaguaaauggug

SEQ ID NO: 3677 - RNA, 22 nt, Artificial Sequence
  Synthetic oligonucleotide
ugacuuccacaggcccuugaag

SEQ ID NO: 3678 - RNA, 22 nt, Artificial Sequence
  Synthetic oligonucleotide
uugacuuccacaggcccuugaa

SEQ ID NO: 3679 - RNA, 22 nt, Artificial Sequence
  Synthetic oligonucleotide
gaacuuugacuuccacaggccc

SEQ ID NO: 3680 - RNA, 22 nt, Artificial Sequence
  Synthetic oligonucleotide
ugaacuuugacuuccacaggcc

SEQ ID NO: 3681 - RNA, 22 nt, Artificial Sequence
  Synthetic oligonucleotide
cugaacuuugacuuccacaggc

SEQ ID NO: 3682 - RNA, 22 nt, Artificial Sequence
  Synthetic oligonucleotide
gcugaacuuugacuuccacagg

SEQ ID NO: 3683 - RNA, 22 nt, Artificial Sequence
  Synthetic oligonucleotide
gcugaacacgacucuccaucag

SEQ ID NO: 3684 - RNA, 22 nt, Artificial Sequence
  Synthetic oligonucleotide
ugcugaacacgacucuccauca

SEQ ID NO: 3685 - RNA, 22 nt, Artificial Sequence
  Synthetic oligonucleotide
uugccuuccugguacaucauag

SEQ ID NO: 3686 - RNA, 22 nt, Artificial Sequence
  Synthetic oligonucleotide
ugcagcugcuccuucaaacuga

SEQ ID NO: 3687 - RNA, 22 nt, Artificial Sequence
  Synthetic oligonucleotide
augucuugcagcugcuccuuca

SEQ ID NO: 3688 - RNA, 22 nt, Artificial Sequence
  Synthetic oligonucleotide
caugucuugcagcugcuccuuc

SEQ ID NO: 3689 - RNA, 22 nt, Artificial Sequence
  Synthetic oligonucleotide
aggcccaugucuugcagcugcu

SEQ ID NO: 3690 - RNA, 22 nt, Artificial Sequence
  Synthetic oligonucleotide
auaccugggaguuuggacuuuu

SEQ ID NO: 3691 - RNA, 22 nt, Artificial Sequence
  Synthetic oligonucleotide
aacaauaccugggaguuuggac

SEQ ID NO: 3692 - RNA, 22 nt, Artificial Sequence
  Synthetic oligonucleotide
accucaagaaaugccuuaugga

SEQ ID NO: 3693 - RNA, 22 nt, Artificial Sequence
  Synthetic oligonucleotide
uaccucaagaaaugccuuaugg

SEQ ID NO: 3694 - RNA, 22 nt, Artificial Sequence
  Synthetic oligonucleotide
uuaccucaagaaaugccuuaug

SEQ ID NO: 3695 - RNA, 22 nt, Artificial Sequence
  Synthetic oligonucleotide
uuuaccucaagaaaugccuuau

SEQ ID NO: 3696 - RNA, 22 nt, Artificial Sequence
  Synthetic oligonucleotide
uucauuuaccucaagaaaugcc

SEQ ID NO: 3697 - RNA, 22 nt, Artificial Sequence
  Synthetic oligonucleotide
agcugcuucacugccuucuuca

SEQ ID NO: 3698 - RNA, 22 nt, Artificial Sequence
  Synthetic oligonucleotide
ucuuauaaaaaccaggaaaggc

SEQ ID NO: 3699 - RNA, 22 nt, Artificial Sequence
  Synthetic oligonucleotide
ucucuuauaaaaaccaggaaag

SEQ ID NO: 3700 - RNA, 22 nt, Artificial Sequence
  Synthetic oligonucleotide
aacuucucuuauaaaaaccagg

SEQ ID NO: 3701 - RNA, 22 nt, Artificial Sequence
  Synthetic oligonucleotide
uucagaggaacuucucuuauaa

SEQ ID NO: 3702 - RNA, 22 nt, Artificial Sequence
  Synthetic oligonucleotide
uguucagaggaacuucucuuau

SEQ ID NO: 3703 - RNA, 22 nt, Artificial Sequence
  Synthetic oligonucleotide
guguucagaggaacuucucuua

SEQ ID NO: 3704 - RNA, 22 nt, Artificial Sequence
  Synthetic oligonucleotide
uaguguucagaggaacuucucu

SEQ ID NO: 3705 - RNA, 22 nt, Artificial Sequence
  Synthetic oligonucleotide
auaguguucagaggaacuucuc

SEQ ID NO: 3706 - RNA, 22 nt, Artificial Sequence
  Synthetic oligonucleotide
aauaguguucagaggaacuucu

SEQ ID NO: 3707 - RNA, 22 nt, Artificial Sequence
  Synthetic oligonucleotide
uaauaguguucagaggaacuuc

SEQ ID NO: 3708 - RNA, 22 nt, Artificial Sequence
  Synthetic oligonucleotide
gauaauaguguucagaggaacu

SEQ ID NO: 3709 - RNA, 22 nt, Artificial Sequence
  Synthetic oligonucleotide
aagauaauaguguucagaggaa

SEQ ID NO: 3710 - RNA, 22 nt, Artificial Sequence
  Synthetic oligonucleotide
gaagauaauaguguucagagga

SEQ ID NO: 3711 - RNA, 22 nt, Artificial Sequence
  Synthetic oligonucleotide
augaagauaauaguguucagag

SEQ ID NO: 3712 - RNA, 22 nt, Artificial Sequence
  Synthetic oligonucleotide
ugcccaugaagauaauaguguu

SEQ ID NO: 3713 - RNA, 22 nt, Artificial Sequence
  Synthetic oligonucleotide
uuguauuuauuuuuacuucugu

SEQ ID NO: 3714 - RNA, 22 nt, Artificial Sequence
  Synthetic oligonucleotide
uuuguauuuauuuuuacuucug

SEQ ID NO: 3715 - RNA, 22 nt, Artificial Sequence
  Synthetic oligonucleotide
ggccauguauuccaaugugaua

SEQ ID NO: 3716 - RNA, 22 nt, Artificial Sequence
  Synthetic oligonucleotide
gccauguauuccaaugugauag

SEQ ID NO: 3717 - RNA, 22 nt, Artificial Sequence
  Synthetic oligonucleotide
ccauguauuccaaugugauagg

SEQ ID NO: 3718 - RNA, 22 nt, Artificial Sequence
  Synthetic oligonucleotide
cauguauuccaaugugauagga

SEQ ID NO: 3719 - RNA, 22 nt, Artificial Sequence
  Synthetic oligonucleotide
auguauuccaaugugauaggaa

SEQ ID NO: 3720 - RNA, 22 nt, Artificial Sequence
  Synthetic oligonucleotide
uguauuccaaugugauaggaac

SEQ ID NO: 3721 - RNA, 22 nt, Artificial Sequence
  Synthetic oligonucleotide
guauuccaaugugauaggaacu

SEQ ID NO: 3722 - RNA, 22 nt, Artificial Sequence
  Synthetic oligonucleotide
accucuggaaaaaggaagguuu

SEQ ID NO: 3723 - RNA, 22 nt, Artificial Sequence
  Synthetic oligonucleotide
ccucuggaaaaaggaagguuua

SEQ ID NO: 3724 - RNA, 22 nt, Artificial Sequence
  Synthetic oligonucleotide
cuggaaaaaggaagguuuaucu

SEQ ID NO: 3725 - RNA, 22 nt, Artificial Sequence
  Synthetic oligonucleotide
uggaaaaaggaagguuuaucuu

SEQ ID NO: 3726 - RNA, 22 nt, Artificial Sequence
  Synthetic oligonucleotide
ggaaaaaggaagguuuaucuuu

SEQ ID NO: 3727 - RNA, 22 nt, Artificial Sequence
  Synthetic oligonucleotide
auucccaugaaucccaugugca

SEQ ID NO: 3728 - RNA, 22 nt, Artificial Sequence
  Synthetic oligonucleotide
uucccaugaaucccaugugcau

SEQ ID NO: 3729 - RNA, 22 nt, Artificial Sequence
  Synthetic oligonucleotide
ccaugaaucccaugugcauuua

SEQ ID NO: 3730 - RNA, 22 nt, Artificial Sequence
  Synthetic oligonucleotide
caauucccgcuuugcuaccacu

SEQ ID NO: 3731 - RNA, 22 nt, Artificial Sequence
  Synthetic oligonucleotide
uucccgcuuugcuaccacuuuc

SEQ ID NO: 3732 - RNA, 22 nt, Artificial Sequence
  Synthetic oligonucleotide
ucccgcuuugcuaccacuuucu

SEQ ID NO: 3733 - RNA, 22 nt, Artificial Sequence
  Synthetic oligonucleotide
cccgcuuugcuaccacuuucua

SEQ ID NO: 3734 - RNA, 22 nt, Artificial Sequence
  Synthetic oligonucleotide
ccgcuuugcuaccacuuucuau

SEQ ID NO: 3735 - RNA, 22 nt, Artificial Sequence
  Synthetic oligonucleotide
cgcuuugcuaccacuuucuauc

SEQ ID NO: 3736 - RNA, 22 nt, Artificial Sequence
  Synthetic oligonucleotide
uugcuaccacuuucuaucagca

SEQ ID NO: 3737 - RNA, 22 nt, Artificial Sequence
  Synthetic oligonucleotide
cuaugaccaagcugggugccug

SEQ ID NO: 3738 - RNA, 22 nt, Artificial Sequence
  Synthetic oligonucleotide
gguauuuaaguuugacaccaua

SEQ ID NO: 3739 - RNA, 22 nt, Artificial Sequence
  Synthetic oligonucleotide
uuaaguuugacaccauaucuga

SEQ ID NO: 3740 - RNA, 22 nt, Artificial Sequence
  Synthetic oligonucleotide
uaaguuugacaccauaucugag

SEQ ID NO: 3741 - RNA, 22 nt, Artificial Sequence
  Synthetic oligonucleotide
ugacaccauaucugagaaaaca

SEQ ID NO: 3742 - RNA, 22 nt, Artificial Sequence
  Synthetic oligonucleotide
gacaccauaucugagaaaacau

SEQ ID NO: 3743 - RNA, 22 nt, Artificial Sequence
  Synthetic oligonucleotide
accauaucugagaaaacaucug

SEQ ID NO: 3744 - RNA, 22 nt, Artificial Sequence
  Synthetic oligonucleotide
ccauaucugagaaaacaucuga

SEQ ID NO: 3745 - RNA, 22 nt, Artificial Sequence
  Synthetic oligonucleotide
cauaucugagaaaacaucugau

SEQ ID NO: 3746 - RNA, 22 nt, Artificial Sequence
  Synthetic oligonucleotide
ucugagaaaacaucugaucaga

SEQ ID NO: 3747 - RNA, 22 nt, Artificial Sequence
  Synthetic oligonucleotide
ugagaaaacaucugaucagauc

SEQ ID NO: 3748 - RNA, 22 nt, Artificial Sequence
  Synthetic oligonucleotide
ugaucagauccacuucuucuuu

SEQ ID NO: 3749 - RNA, 22 nt, Artificial Sequence
  Synthetic oligonucleotide
agauccacuucuucuuugccaa

SEQ ID NO: 3750 - RNA, 22 nt, Artificial Sequence
  Synthetic oligonucleotide
gauccacuucuucuuugccaaa

SEQ ID NO: 3751 - RNA, 22 nt, Artificial Sequence
  Synthetic oligonucleotide
acuucuucuuugccaaacugaa

SEQ ID NO: 3752 - RNA, 22 nt, Artificial Sequence
  Synthetic oligonucleotide
ugccaaacugaacugccgacuc

SEQ ID NO: 3753 - RNA, 22 nt, Artificial Sequence
  Synthetic oligonucleotide
gccaaacugaacugccgacucu

SEQ ID NO: 3754 - RNA, 22 nt, Artificial Sequence
  Synthetic oligonucleotide
ccaaacugaacugccgacucua

SEQ ID NO: 3755 - RNA, 22 nt, Artificial Sequence
  Synthetic oligonucleotide
ugaacugccgacucuaucgaaa

SEQ ID NO: 3756 - RNA, 22 nt, Artificial Sequence
  Synthetic oligonucleotide
gaacugccgacucuaucgaaaa

SEQ ID NO: 3757 - RNA, 22 nt, Artificial Sequence
  Synthetic oligonucleotide
aacugccgacucuaucgaaaag

SEQ ID NO: 3758 - RNA, 22 nt, Artificial Sequence
  Synthetic oligonucleotide
gccgacucuaucgaaaagccaa

SEQ ID NO: 3759 - RNA, 22 nt, Artificial Sequence
  Synthetic oligonucleotide
acucuaucgaaaagccaacaaa

SEQ ID NO: 3760 - RNA, 22 nt, Artificial Sequence
  Synthetic oligonucleotide
cgaaaagccaacaaauccucca

SEQ ID NO: 3761 - RNA, 22 nt, Artificial Sequence
  Synthetic oligonucleotide
agccaacaaauccuccaaguua

SEQ ID NO: 3762 - RNA, 22 nt, Artificial Sequence
  Synthetic oligonucleotide
caaucgccuuuuuggagacaaa

SEQ ID NO: 3763 - RNA, 22 nt, Artificial Sequence
  Synthetic oligonucleotide
aaaucccuuaccuucaaugaga

SEQ ID NO: 3764 - RNA, 22 nt, Artificial Sequence
  Synthetic oligonucleotide
ugcugguuaacaccauuuacuu

SEQ ID NO: 3765 - RNA, 22 nt, Artificial Sequence
  Synthetic oligonucleotide
gcugguuaacaccauuuacuuc

SEQ ID NO: 3766 - RNA, 22 nt, Artificial Sequence
  Synthetic oligonucleotide
caccauuuacuucaagggccug

SEQ ID NO: 3767 - RNA, 22 nt, Artificial Sequence
  Synthetic oligonucleotide
cuucaagggccuguggaaguca

SEQ ID NO: 3768 - RNA, 22 nt, Artificial Sequence
  Synthetic oligonucleotide
uucaagggccuguggaagucaa

SEQ ID NO: 3769 - RNA, 22 nt, Artificial Sequence
  Synthetic oligonucleotide
gggccuguggaagucaaaguuc

SEQ ID NO: 3770 - RNA, 22 nt, Artificial Sequence
  Synthetic oligonucleotide
ggccuguggaagucaaaguuca

SEQ ID NO: 3771 - RNA, 22 nt, Artificial Sequence
  Synthetic oligonucleotide
gccuguggaagucaaaguucag

SEQ ID NO: 3772 - RNA, 22 nt, Artificial Sequence
  Synthetic oligonucleotide
ccuguggaagucaaaguucagc

SEQ ID NO: 3773 - RNA, 22 nt, Artificial Sequence
  Synthetic oligonucleotide
cugauggagagucguguucagc

SEQ ID NO: 3774 - RNA, 22 nt, Artificial Sequence
  Synthetic oligonucleotide
ugauggagagucguguucagca

SEQ ID NO: 3775 - RNA, 22 nt, Artificial Sequence
  Synthetic oligonucleotide
cuaugauguaccaggaaggcaa

SEQ ID NO: 3776 - RNA, 22 nt, Artificial Sequence
  Synthetic oligonucleotide
ucaguuugaaggagcagcugca

SEQ ID NO: 3777 - RNA, 22 nt, Artificial Sequence
  Synthetic oligonucleotide
ugaaggagcagcugcaagacau

SEQ ID NO: 3778 - RNA, 22 nt, Artificial Sequence
  Synthetic oligonucleotide
gaaggagcagcugcaagacaug

SEQ ID NO: 3779 - RNA, 22 nt, Artificial Sequence
  Synthetic oligonucleotide
agcagcugcaagacaugggccu

SEQ ID NO: 3780 - RNA, 22 nt, Artificial Sequence
  Synthetic oligonucleotide
aaaaguccaaacucccagguau

SEQ ID NO: 3781 - RNA, 22 nt, Artificial Sequence
  Synthetic oligonucleotide
guccaaacucccagguauuguu

SEQ ID NO: 3782 - RNA, 22 nt, Artificial Sequence
  Synthetic oligonucleotide
uccauaaggcauuucuugaggu

SEQ ID NO: 3783 - RNA, 22 nt, Artificial Sequence
  Synthetic oligonucleotide
ccauaaggcauuucuugaggua

SEQ ID NO: 3784 - RNA, 22 nt, Artificial Sequence
  Synthetic oligonucleotide
cauaaggcauuucuugagguaa

SEQ ID NO: 3785 - RNA, 22 nt, Artificial Sequence
  Synthetic oligonucleotide
auaaggcauuucuugagguaaa

SEQ ID NO: 3786 - RNA, 22 nt, Artificial Sequence
  Synthetic oligonucleotide
ggcauuucuugagguaaaugaa

SEQ ID NO: 3787 - RNA, 22 nt, Artificial Sequence
  Synthetic oligonucleotide
ugaagaaggcagugaagcagcu

SEQ ID NO: 3788 - RNA, 22 nt, Artificial Sequence
  Synthetic oligonucleotide
gccuuuccugguuuuuauaaga

SEQ ID NO: 3789 - RNA, 22 nt, Artificial Sequence
  Synthetic oligonucleotide
cuuuccugguuuuuauaagaga

SEQ ID NO: 3790 - RNA, 22 nt, Artificial Sequence
  Synthetic oligonucleotide
ccugguuuuuauaagagaaguu

SEQ ID NO: 3791 - RNA, 22 nt, Artificial Sequence
  Synthetic oligonucleotide
uuauaagagaaguuccucugaa

SEQ ID NO: 3792 - RNA, 22 nt, Artificial Sequence
  Synthetic oligonucleotide
auaagagaaguuccucugaaca

SEQ ID NO: 3793 - RNA, 22 nt, Artificial Sequence
  Synthetic oligonucleotide
uaagagaaguuccucugaacac

SEQ ID NO: 3794 - RNA, 22 nt, Artificial Sequence
  Synthetic oligonucleotide
agagaaguuccucugaacacua

SEQ ID NO: 3795 - RNA, 22 nt, Artificial Sequence
  Synthetic oligonucleotide
gagaaguuccucugaacacuau

SEQ ID NO: 3796 - RNA, 22 nt, Artificial Sequence
  Synthetic oligonucleotide
agaaguuccucugaacacuauu

SEQ ID NO: 3797 - RNA, 22 nt, Artificial Sequence
  Synthetic oligonucleotide
gaaguuccucugaacacuauua

SEQ ID NO: 3798 - RNA, 22 nt, Artificial Sequence
  Synthetic oligonucleotide
aguuccucugaacacuauuauc

SEQ ID NO: 3799 - RNA, 22 nt, Artificial Sequence
  Synthetic oligonucleotide
uuccucugaacacuauuaucuu

SEQ ID NO: 3800 - RNA, 22 nt, Artificial Sequence
  Synthetic oligonucleotide
uccucugaacacuauuaucuuc

SEQ ID NO: 3801 - RNA, 22 nt, Artificial Sequence
  Synthetic oligonucleotide
cucugaacacuauuaucuucau

SEQ ID NO: 3802 - RNA, 22 nt, Artificial Sequence
  Synthetic oligonucleotide
aacacuauuaucuucaugggca

SEQ ID NO: 3803 - RNA, 22 nt, Artificial Sequence
  Synthetic oligonucleotide
acagaaguaaaaauaaauacaa

SEQ ID NO: 3804 - RNA, 22 nt, Artificial Sequence
  Synthetic oligonucleotide
cagaaguaaaaauaaauacaaa

We claim:

1. A nucleic acid comprising an oligonucleotide strand of 15-80 nucleotides in length, wherein said oligonucleotide strand is sufficiently complementary to a target AT3 mRNA sequence selected from SEQ ID NOs: 1921-2304 along at least 15 nucleotides of said oligonucleotide strand length to reduce AT3 target mRNA expression when said nucleic acid is introduced into a mammalian cell, wherein said oligonucleotide strand comprises a sequence selected from the group consisting of SEQ ID NOs: 385-768, and wherein said oligonucleotide strand comprises one or more modified nucleotides.

2. The nucleic acid of claim 1, wherein said oligonucleotide strand is 19-35 nucleotides in length.

3. A double stranded nucleic acid (dsNA) comprising first and second nucleic acid strands comprising RNA, wherein said first strand is 15-66 nucleotides in length and said second strand of said dsNA is 19-66 nucleotides in length, wherein said second oligonucleotide strand is sufficiently complementary to a target AT3 mRNA sequence selected from SEQ ID NOs: 1921-2304 along at least 15 nucleotides of said second oligonucleotide strand length to reduce AT3 target mRNA expression when said double stranded nucleic acid is introduced into a mammalian cell, and wherein said second strand comprises a sequence selected from the group consisting of SEQ ID NOs: 385-768.

4. The dsNA of claim 3, wherein said first strand is 15-35 nucleotides in length.

5. The dsNA of claim 3, wherein said second strand is 19-35 nucleotides in length.

6. The dsNA of claim 3 comprising a duplex region selected from the group consisting of at least 25 base pairs, 19-21 base pairs, and 21-25 base pairs.

7. The dsNA of claim 3, wherein said first strand comprises a sequence selected from the group consisting of SEQ ID NOs: 1-384.

8. A double stranded nucleic acid (dsNA) comprising first and second nucleic acid strands comprising RNA, wherein said first strand is 15-66 nucleotides in length and said second strand of said dsNA is 19-66 nucleotides in length, wherein said second oligonucleotide strand is sufficiently complementary to a target AT3 mRNA sequence selected from SEQ ID NOs: 1921-2304 along at least 15 nucleotides of said second oligonucleotide strand length to reduce AT3 target mRNA expression when said double stranded nucleic acid is introduced into a mammalian cell, and wherein said first strand comprises a sequence selected from the group consisting of SEQ ID NOs: 1-384.

9. The dsNA of claim 3 comprising a modified nucleotide selected from the group consisting of a deoxyribonucleotide, a dideoxyribonucleotide, an acyclonucleotide, a 3'-deoxyadenosine (cordycepin), a 3'-azido-3'-deoxythymidine (AZT), a 2',3'-dideoxyinosine (ddI), a 2',3'-dideoxy-3'-thiacytidine (3TC), a 2',3'-didehydro-2',3'-dideoxythymidine (d4T), a monophosphate nucleotide of 3'-azido-3'-deoxythymidine (AZT), a 2',3'-dideoxy-3'-thiacytidine (3TC) and a monophosphate nucleotide of 2',3'-didehydro-2',3'-dideoxythymidine (d4T), a 4-thiouracil, a 5-bromouracil, a 5-iodouracil, a 5-(3-aminoallyl)-uracil, a 2'-O-alkyl ribonucleotide, a 2'-O-methyl ribonucleotide, a 2'-amino ribonucleotide, a 2'-fluoro ribonucleotide, and a locked nucleic acid.

10. The dsNA of claim 3 comprising a phosphate backbone modification selected from the group consisting of a phosphonate, a phosphorothioate and a phosphotriester.

11. A method for reducing expression of a target AT3 gene in a mammalian cell comprising contacting a mammalian cell in vitro with the dsNA of claim 3 in an amount sufficient to reduce expression of a target AT3 mRNA in said cell.

12. A formulation comprising the dsNA of claim 3, wherein said dsNA is present in an amount effective to reduce target AT3 mRNA levels when said dsNA is introduced into a mammalian cell in vitro by an amount (expressed by %) selected from the group consisting of at least 10%, at least 50% and at least 80-90%.

13. A formulation comprising the dsNA of claim 3, wherein said dsNA is present in an amount effective to reduce target AT3 mRNA levels when said dsNA is introduced into a cell of a mammalian subject by an amount (expressed by %) selected from the group consisting of at least 10%, at least 50% and at least 80-90%.

14. An isolated mammalian cell containing the dsNA of claim 3.

15. A pharmaceutical composition comprising the dsNA of claim 3 and a pharmaceutically acceptable carrier.

16. A kit comprising the dsNA of claim 3 and instructions for its use.

17. The nucleic acid of claim 1, wherein the one or more modified nucleotides is selected from the group consisting of a deoxyribonucleotide, a dideoxyribonucleotide, an acyclonucleotide, a 3'-deoxyadenosine (cordycepin), a 3'-azido-3'-deoxythymidine (AZT), a 2',3'-dideoxyinosine (ddI), a 2',3'-dideoxy-3'-thiacytidine (3TC), a 2',3'-didehydro-2',3'-dideoxythymidine (d4T), a monophosphate nucleotide of 3'-azido-3'-deoxythymidine (AZT), a 2',3'-dideoxy-3'-thiacytidine (3TC) and a monophosphate nucleotide of 2',3'-didehydro-2',3'-dideoxythymidine (d4T), a 4-thiouracil, a 5-bromouracil, a 5-iodouracil, a 5-(3-aminoallyl)-uracil, a 2'-O-alkyl ribonucleotide, a 2'-O-methyl ribonucleotide, a 2'-amino ribonucleotide, a 2'-fluoro ribonucleotide, and a locked nucleic acid.

18. The nucleic acid of claim 1 comprising a phosphate backbone modification selected from the group consisting of a phosphonate, a phosphorothioate and a phosphotriester.

19. A method for reducing expression of a target AT3 gene in a mammalian cell comprising contacting a mammalian cell in vitro with the nucleic acid of claim 1 in an amount sufficient to reduce expression of a target AT3 mRNA in said cell.

20. A formulation comprising the nucleic acid of claim 1, wherein said nucleic acid is present in an amount effective to reduce target AT3 mRNA levels when said nucleic acid is introduced into a mammalian cell in vitro by an amount (expressed by %) selected from the group consisting of at least 10%, at least 50% and at least 80-90%.

21. A formulation comprising the nucleic acid of claim 1, wherein said nucleic acid is present in an amount effective to reduce target AT3 mRNA levels when said nucleic acid is introduced into a cell of a mammalian subject by an amount (expressed by %) selected from the group consisting of at least 10%, at least 50% and at least 80-90%.

22. An isolated mammalian cell containing the nucleic acid of claim 1.

23. A pharmaceutical composition comprising the nucleic acid of claim 1 and a pharmaceutically acceptable carrier.

24. A kit comprising the nucleic acid of claim 1 and instructions for its use.

25. The dsNA of claim 8 comprising a modified nucleotide selected from the group consisting of a deoxyribonucleotide, a dideoxyribonucleotide, an acyclonucleotide, a 3'-deoxyadenosine (cordycepin), a 3'-azido-3'-deoxythymidine (AZT), a 2',3'-dideoxyinosine (ddI), a 2',3'-dideoxy-3'-thiacytidine (3TC), a 2',3'-didehydro-2',3'-dideoxythymidine (d4T), a monophosphate nucleotide of 3'-azido-3'-deoxythymidine (AZT), a 2',3'-dideoxy-3'-thiacytidine (3TC) and a monophosphate nucleotide of 2',3'-didehydro-2',3'-dideoxythymidine (d4T), a 4-thiouracil, a 5-bromouracil, a 5-iodouracil, a 5-(3-aminoallyl)-uracil, a 2'-O-alkyl ribonucleotide, a 2'-O-methyl ribonucleotide, a 2'-amino ribonucleotide, a 2'-fluoro ribonucleotide, and a locked nucleic acid.

26. The dsNA of claim 8 comprising a phosphate backbone modification selected from the group consisting of a phosphonate, a phosphorothioate and a phosphotriester.

27. A method for reducing expression of a target AT3 gene in a mammalian cell comprising contacting a mammalian cell in vitro with the dsNA of claim 8 in an amount sufficient to reduce expression of a target AT3 mRNA in said cell.

28. A formulation comprising the dsNA of claim 8, wherein said dsNA is present in an amount effective to reduce target AT3 mRNA levels when said dsNA is introduced into a mammalian cell in vitro by an amount (expressed by %) selected from the group consisting of at least 10%, at least 50% and at least 80-90%.

29. A formulation comprising the dsNA of claim 8, wherein said dsNA is present in an amount effective to reduce target AT3 mRNA levels when said dsNA is introduced into a cell of a mammalian subject by an amount (expressed by %) selected from the group consisting of at least 10%, at least 50% and at least 80-90%.

30. An isolated mammalian cell containing the dsNA of claim 8.

31. A pharmaceutical composition comprising the dsNA of claim 8 and a pharmaceutically acceptable carrier.

32. A kit comprising the dsNA of claim 8 and instructions for its use.

* * * * *